(12) United States Patent
Meyer et al.

(10) Patent No.: US 8,143,473 B2
(45) Date of Patent: Mar. 27, 2012

(54) **DGAT GENES FROM *YARROWIA LIPOLYTICA* FOR INCREASED SEED STORAGE LIPID PRODUCTION AND ALTERED FATTY ACID PROFILES IN SOYBEAN**

(75) Inventors: Knut Meyer, Wilmington, DE (US); William D. Hitz, Wilmington, DE (US); Narendra S. Yadav, Chadds Ford, PA (US); Howard G. Damude, Hockessin, DE (US)

(73) Assignee: E. I. du Pont de Nemours and Company, Wilmington, DE (US)

( * ) Notice: Subject to any disclaimer, the term of this patent is extended or adjusted under 35 U.S.C. 154(b) by 700 days.

(21) Appl. No.: 12/126,161

(22) Filed: May 23, 2008

(65) Prior Publication Data

US 2008/0295204 A1 Nov. 27, 2008

Related U.S. Application Data

(60) Provisional application No. 60/939,872, filed on May 24, 2007, provisional application No. 61/013,406, filed on Dec. 13, 2007.

(51) Int. Cl.
| | |
|---|---|
| *A01H 1/00* | (2006.01) |
| *A01H 5/00* | (2006.01) |
| *A01H 5/10* | (2006.01) |
| *C12N 5/14* | (2006.01) |
| *C12N 15/82* | (2006.01) |
| *C07H 21/04* | (2006.01) |

(52) U.S. Cl. ........ 800/278; 800/281; 800/298; 800/312; 800/320.1; 536/23.2; 536/23.74; 435/410; 435/412; 435/415; 435/320.1; 435/468

(58) Field of Classification Search .......... None
See application file for complete search history.

(56) References Cited

U.S. PATENT DOCUMENTS

| | | | |
|---|---|---|---|
| 6,100,077 | A | 8/2000 | Sturley et al. |
| 6,344,548 | B1 | 2/2002 | Farese, Jr. et al. |
| 6,995,301 | B1 * | 2/2006 | Shorrosh ........... 800/281 |
| 7,273,746 | B2 * | 9/2007 | Yadav et al. ........... 435/254.2 |
| 7,423,203 | B2 * | 9/2008 | Cheikh et al. ........... 800/320.1 |
| 2003/0115632 | A1 | 6/2003 | Lardizabal et al. |
| 2006/0094088 | A1 | 5/2006 | Picataggio et al. |
| 2008/0095915 | A1 | 4/2008 | Damude et al. |

FOREIGN PATENT DOCUMENTS

| | | |
|---|---|---|
| WO | WO 98/55631 | 12/1998 |
| WO | 99/67403 | 12/1999 |
| WO | WO 00/01713 | 1/2000 |
| WO | WO 2004/011671 | 2/2004 |
| WO | WO 2005/003322 | 1/2005 |

OTHER PUBLICATIONS

Katavic et al., Plant Physiology (1995), vol. 108, pp. 399-409.*
Lardizabel et al., Journal of Biological Chemistry, vol. 276(42), pp. 38862-28869. DGAT2 is a New Diacylglycerol Acyltransferase Gene Family. Purification, Cloning and Expression in Insect Cells of Two Polypeptides from Mortierella Ramanniana with Diacylglycerol Acyltransferase Activity, 2001.
Bennett et al., Modification of Seed Oil Content in Soybean (Glycine max) by Expression of a Mortierella Remanniana Diacylglycerol Acyltransferase. Annual Meeting of the American Society of Plant Biologists, Plant Biology, 2004.
Hildebrand et al., Genomics of Soybean Oil Traits. Genetics and Genomics of Soybean Springer, Plant Genetics and Genomics—Crops and Models, p. 185-209, 2008.
PCT/US2008/064621 International Search Report.

* cited by examiner

*Primary Examiner* — Eileen B O Hara

(57) ABSTRACT

Transgenic soybean seed having increased total fatty acid content of at least 10% and altered fatty acid profiles when compared to the total fatty acid content of non-transgenic, null segregant soybean seed are described. DGAT genes from *Yarrowia lipolytica* are used to achieve the increase in seed storage lipids.

55 Claims, 9 Drawing Sheets

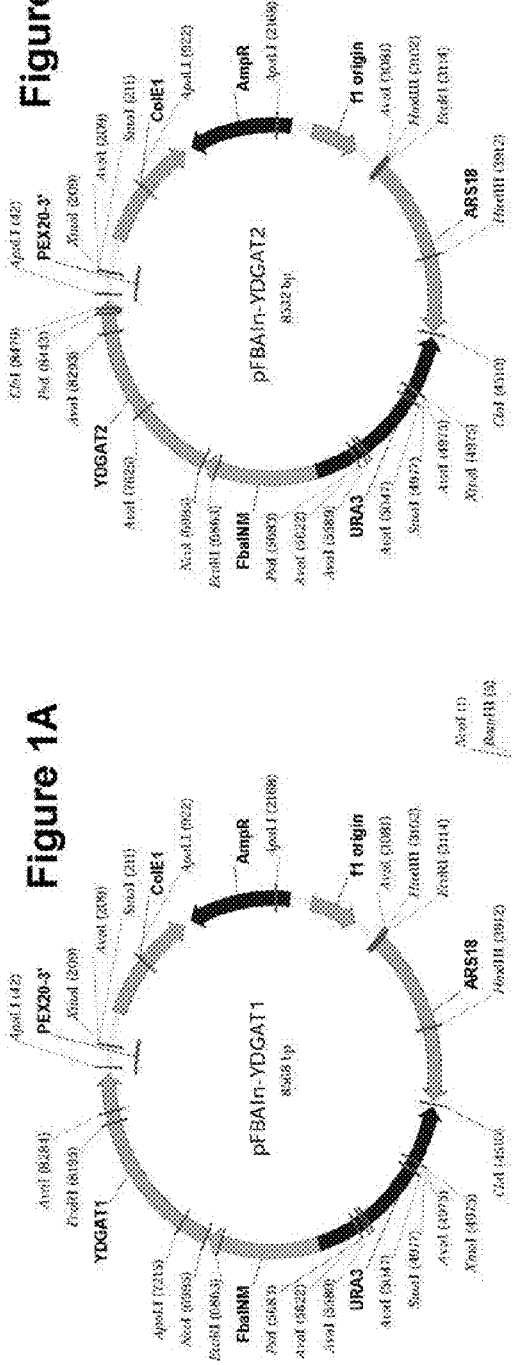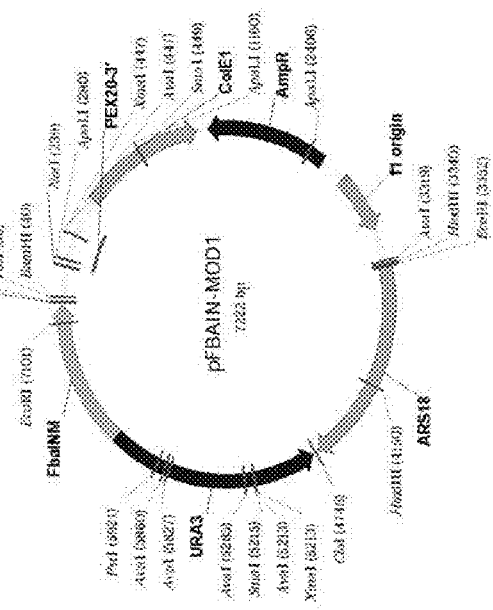

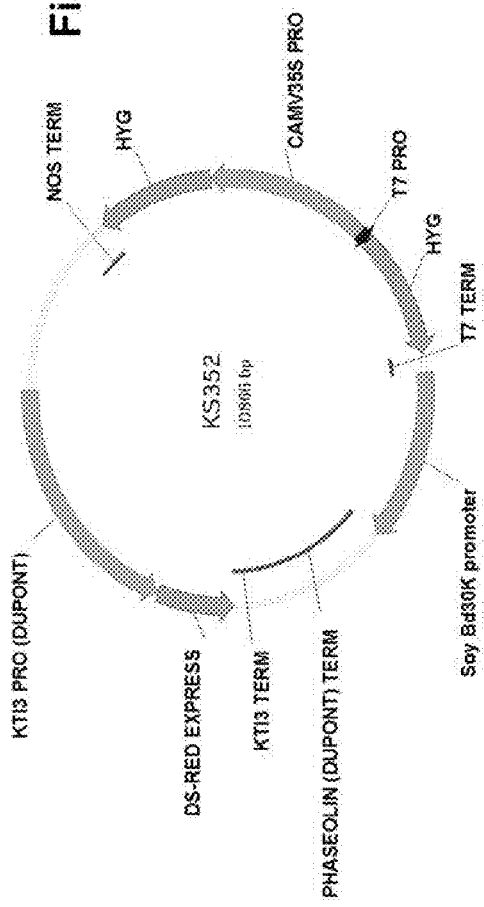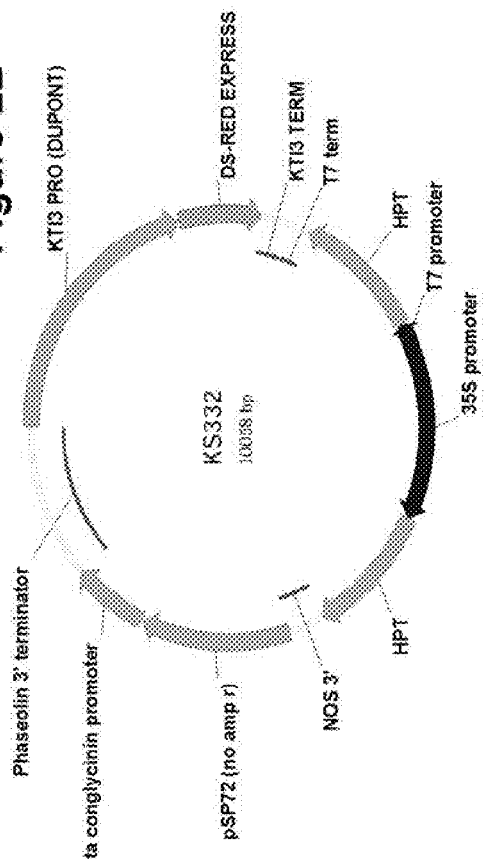

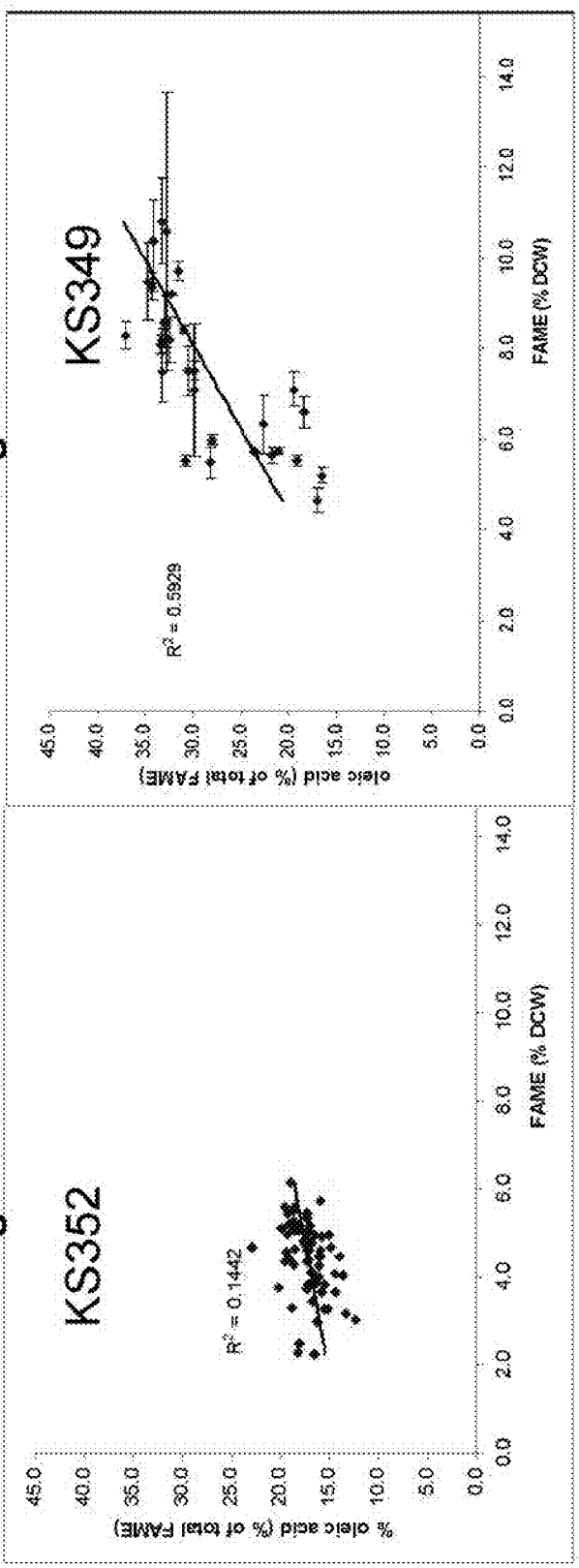

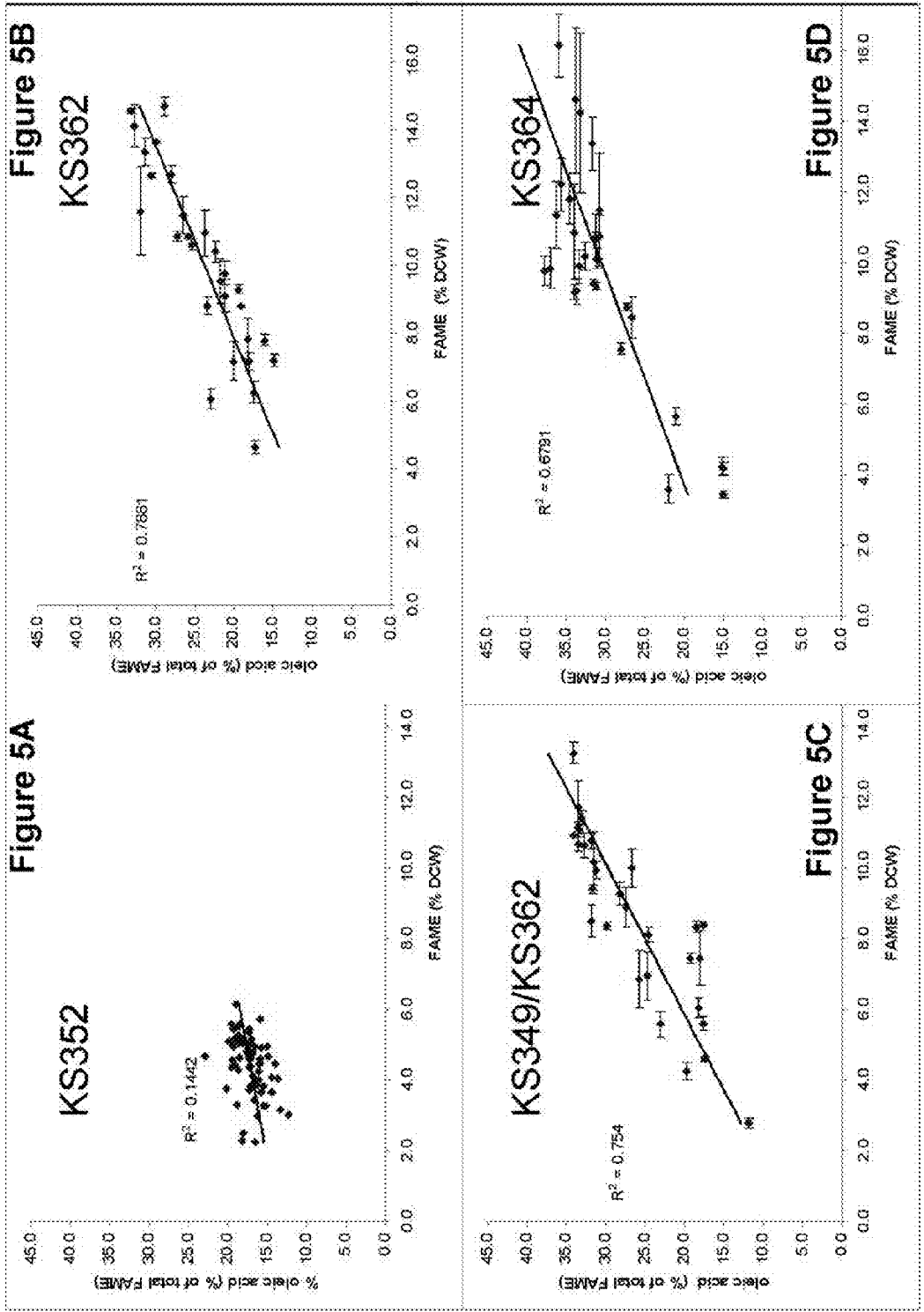

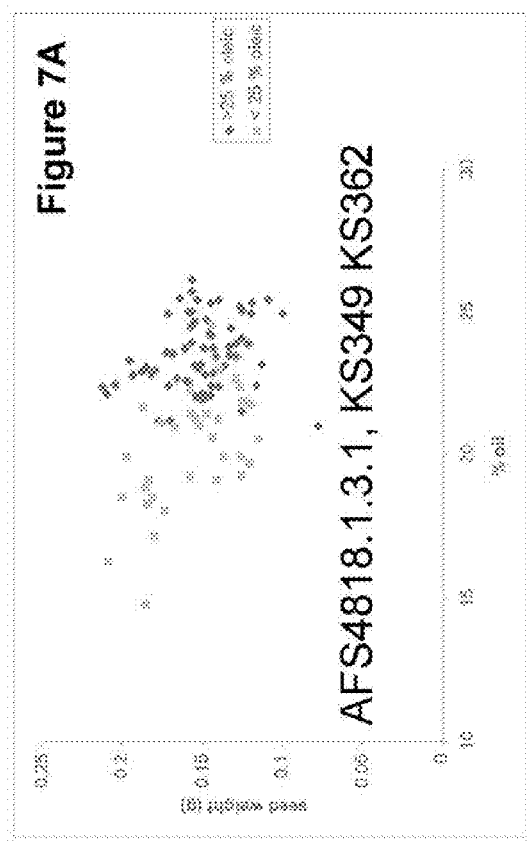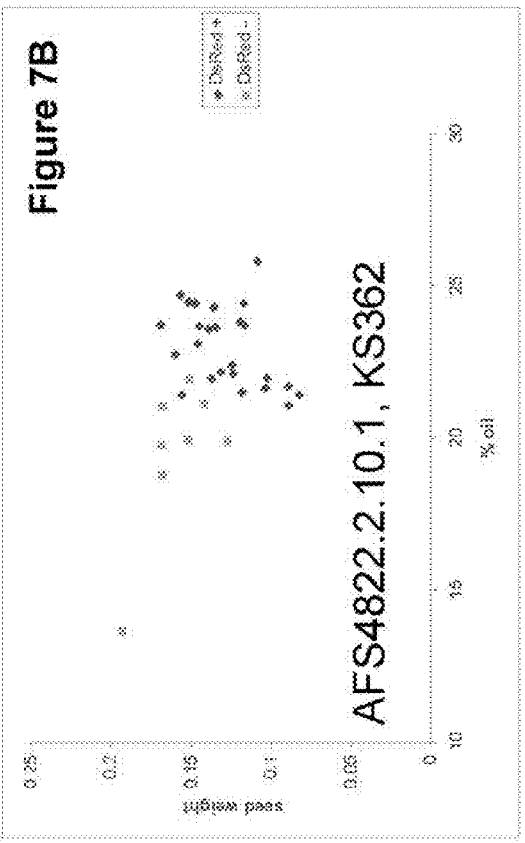

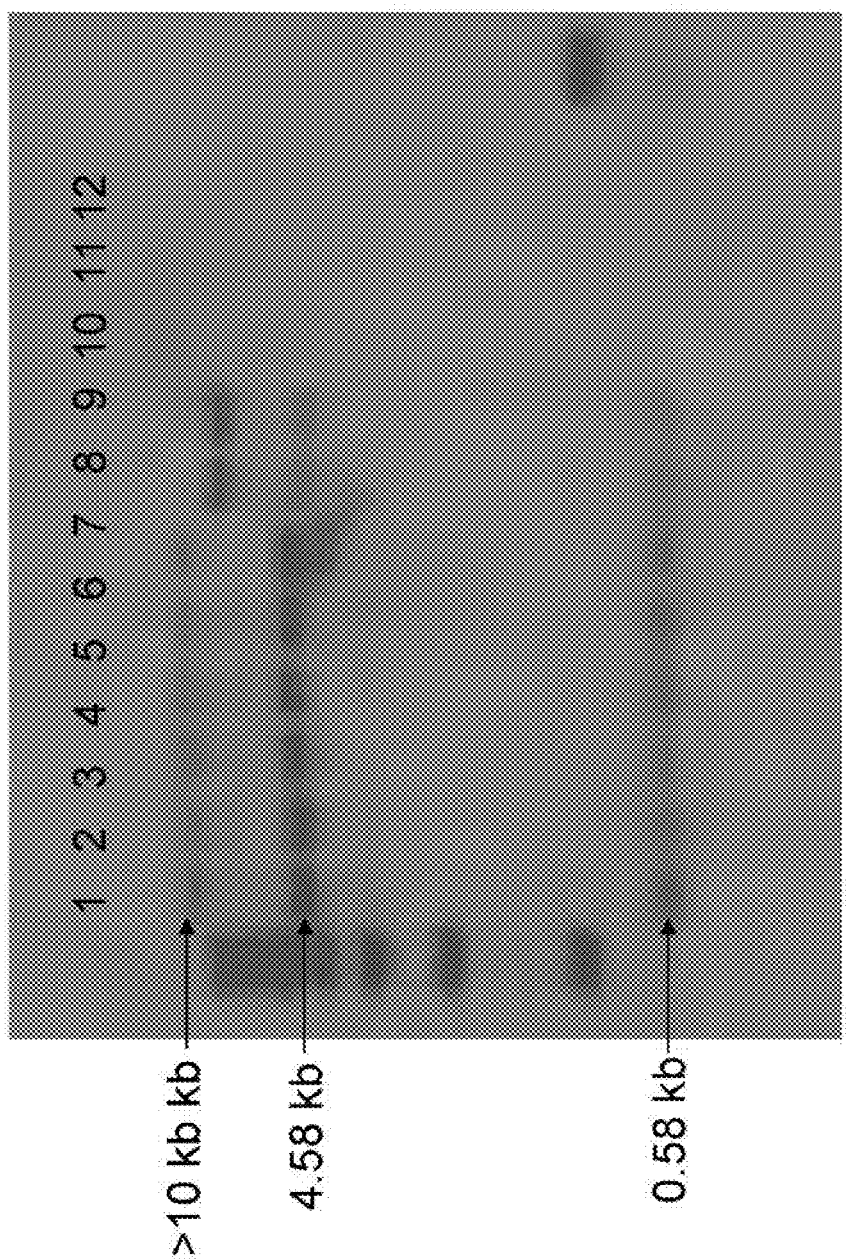

Figure 3A:
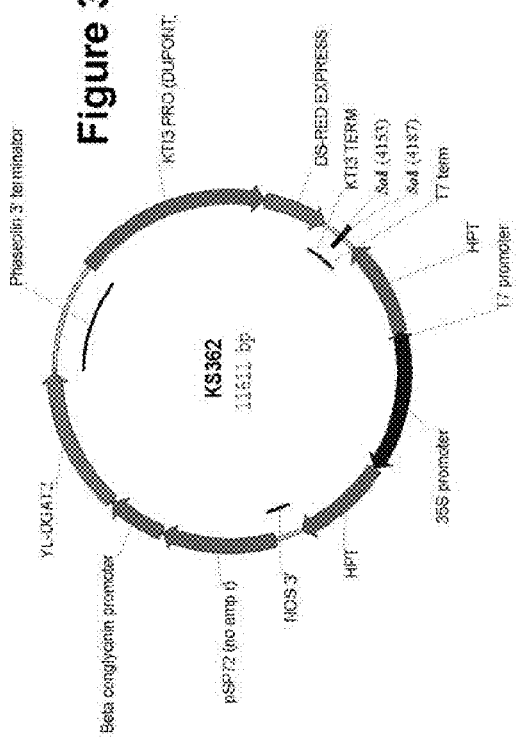

DGAT GENES FROM *YARROWIA LIPOLYTICA* FOR INCREASED SEED STORAGE LIPID PRODUCTION AND ALTERED FATTY ACID PROFILES IN SOYBEAN

This application claims the benefit of U.S. Provisional Application No. 60/939,872, filed May 24, 2007, and U.S. Provisional Application No. 61/013,406, filed Dec. 13, 2007, the disclosures of which are hereby incorporated in their entirety.

FIELD OF THE INVENTION

This invention is in the field of biotechnology, in particular, this pertains to polynucleotide sequences encoding diacylglycerol acyltransferase genes and the use of these acyltransferases for increased seed storage lipid production and altered fatty acid profiles in soybean.

BACKGROUND OF THE INVENTION

Plant lipids have a variety of industrial and nutritional uses and are central to plant membrane function and climatic adaptation. These lipids represent a vast array of chemical structures, and these structures determine the physiological and industrial properties of the lipid. Many of these structures result either directly or indirectly from metabolic processes that alter the degree of unsaturation of the lipid. Different metabolic regimes in different plants produce these altered lipids, and either domestication of exotic plant species or modification of agronomically adapted species is usually required to produce economically large amounts of the desired lipid.

There are serious limitations to using mutagenesis to alter fatty acid composition and content. Screens will rarely uncover mutations that a) result in a dominant ("gain-of-function") phenotype, b) are in genes that are essential for plant growth, and c) are in an enzyme that is not rate-limiting and that is encoded by more than one gene. In cases where desired phenotypes are available in mutant corn lines, their introgression into elite lines by traditional breeding techniques is slow and expensive, since the desired oil compositions are likely the result of several recessive genes.

Recent molecular and cellular biology techniques offer the potential for overcoming some of the limitations of the mutagenesis approach, including the need for extensive breeding. Some of the particularly useful technologies are seed-specific expression of foreign genes in transgenic plants [see Goldberg et al (1989) *Cell* 56:149-160], and the use of antisense RNA to inhibit plant target genes in a dominant and tissue-specific manner [see van der Krol et al (1988) *Gene* 72:45-50]. Other advances include the transfer of foreign genes into elite commercial varieties of commercial oilcrops, such as soybean [Chee et al (1989) *Plant Physiol.* 91:1212-1218; Christou et al (1989) *Proc. Natl. Acad. Sci. U.S.A.* 86:7500-7504; Hinchee et al (1988) *Bio/Technology* 6:915-922; EPO publication 0 301 749 A2], rapeseed [De Block et al (1989) *Plant Physiol.* 91:694-701], and sunflower [Everett et al (1987) *Bio/Technology* 5:1201-1204], and the use of genes as restriction fragment length polymorphism (RFLP) markers in a breeding program, which makes introgression of recessive traits into elite lines rapid and less expensive [Tanksley et al (1989) *Bio/Technology* 7:257-264]. However, application of each of these technologies requires identification and isolation of commercially-important genes.

Most free fatty acids become esterified to coenzyme A (CoA), to yield acyl-CoAs. These molecules are then substrates for glycerolipid synthesis in the endoplasmic reticulum of the cell, where phosphatidic acid and diacylglycerol (DAG) are produced. Either of these metabolic intermediates may be directed to membrane phospholipids (e.g., phosphatidylglycerol, phosphatidylethanolamine, phosphatidylcholine) or DAG may be directed to form triacylglycerols (TAGs), the primary storage reserve of lipids in eukaryotic cells.

Diacylglycerol acyltransferase ("DGAT") is an integral membrane protein that catalyzes the final enzymatic step in the production of triacylglycerols in plants, fungi and mammals. This enzyme is responsible for transferring an acyl group from acyl-coenzyme-A to the sn-3 position of 1,2-diacylglycerol ("DAG") to form triacylglycerol ("TAG"). DGAT is associated with membrane and lipid body fractions in plants and fungi, particularly, in oilseeds where it contributes to the storage of carbon used as energy reserves. TAG is believed to be an important chemical for storage of energy in cells. DGAT is known to regulate TAG structure an direct TAG synthesis. Furthermore, it is known that the DGAT reaction is specific for oil synthesis.

TAG is the primary component of vegetable oil in plants, It is used by the seed as a stored form of energy to be used during seed germination.

Two different families of DGAT proteins have been identified. The first family of DGAT proteins ("DGAT1") is related to the acyl-coenzyme A:cholesterol acyltransferase ("ACAT") and has been described in U.S. Pat. Nos. 6,100,077 and 6,344,548. A second family of DGAT proteins ("DGAT2") is unrelated to the DGAT1 family and is described in PCT Patent Publication WO 2004/011671 published Feb. 5, 2004. Other references to DGAT genes and their use in plants include PCT Publication Nos. WO2004/011, 671, WO1998/055,631, and WO2000/001,713, and US Patent Publication No. 20030115632.

Applicants' Assignee's copending published patent application US 2006-0094088 describes genes for DGATs of plants and fungi and their use is in modifying levels of polyunsaturated fatty acids ("PUFAs") in edible oils.

Applicants' Assignee's published PCT application WO 2005/003322 describes the cloning of phosphatidylcholine diacylglycerol acyltransferase and DGAT2 for altering PUFA and oil content in oleaginous yeast.

SUMMARY OF THE INVENTION

The present invention concerns a transgenic soybean seed having increased total fatty acid content of at least 10% when compared to the total fatty acid content of a non-transgenic, null segregant soybean seed.

In a second embodiment, the present invention concerns a method for increasing the total fatty acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% when compared to the total fatty acid content of a non-transgenic, null segregant soybean seed.

In a third embodiment, the present invention concerns a transgenic corn kernel having increased total fatty acid content of at least 10% when compared to the total fatty acid content of a non-transgenic, null segregant corn kernel.

In a fourth embodiment, the present invention concerns a method for increasing the total fatty acid content of a corn kernel comprising:

(a) transforming at least one corn kernel with a recombinant construct having at least one DGAT sequence;

(b) selecting the transformed corn kernel(s) of step (a) having an increased total fatty acid content of at least 10% when compared to the total fatty acid content of a non-transgenic, null segregant corn kernel.

In a fifth embodiment, the present invention concerns a transgenic soybean seed having increased total fatty acid content of at least 10% and an increased oleic acid content of at least 25% when compared to the total fatty acid content and oleic acid content of a non-transgenic, null segregant soybean seed.

In a further embodiment, the present invention concerns a transgenic soybean having increased total fatty acid content of at least 10% and at least any one of i) an increased oleic acid content of at least 25%; ii) a decreased linolenic acid content of at least 25%; iii) a decreased linoleic acid content of at least 4%; iv) a decreased palmitic acid content of at least 8%; and v) an increased stearic acid content of at lease 14% when compared to the total fatty acid content and oleic, linolenic acid, linoelic acid, palmitic acid or stearic acid, respectively, content of a non-transgenic, null segregant soybean seed.

In an sixth embodiment, the present invention concerns a method for increasing the total fatty acid content and oleic acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% and an increased oleic acid content of at least 25% when compared to the total fatty acid content and oleic acid content of a non-transgenic, null segregant soybean seed.

In a seventh embodiment, the present invention concerns a method for increasing the total fatty acid content and decreasing linolenic acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% and a decreased linolenic acid content of at least 25% when compared to the total fatty acid content and oleic acid content of a non-transgenic, null segregant soybean seed.

In an eighth embodiment, the present invention concerns a method for increasing the total fatty acid content and decreasing linoleic acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% and a decreased linoleic acid content of at least 4% when compared to the total fatty acid content and oleic acid content of a non-transgenic, null segregant soybean seed.

In a ninth embodiment, the present invention concerns a method for increasing the total fatty acid content and decreased palmitic acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% and a decreased palmitic acid content of at least 8% when compared to the total fatty acid content and oleic acid content of a non-transgenic, null segregant soybean seed.

In a tenth embodiment, the present invention concerns a method for increasing the total fatty acid content and stearic acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% and an increased stearic acid content of at least 14% when compared to the total fatty acid content and oleic acid content of a non-transgenic, null segregant soybean seed.

Any of the transgenic seed of the invention may comprise a recombinant construct having at least one DGAT sequence which can be selected from the group consisting of DGAT1, DGAT2 and DGAT1 in combination with DGAT2. Furthermore, the DGAT sequence can be a *Yarrowia* sequence.

Also within the scope of the invention are product(s) and/or by-product(s) obtained from the transgenic soybean seeds of the invention.

Also within the scope of the invention are mutated versions of *Yarrowia* DGATs that retain function. Particular examples include, but are not limited to, an isolated polynucleotide comprising a nucleotide sequence encoding a polypeptide having diacylglycerol acyltransferase activity wherein the polypeptide is set forth in SEQ ID NOs:83, 88, or 93. The complement of the nucleotide sequence, recombinant DNA constructs comprising the nucleotide sequence, and cells incorporating the recombinant DNA constructs are also within the scope of the invention. Oilseed plants are useful for comprising the recombinant constructs.

BRIEF DESCRIPTION OF THE DRAWINGS AND SEQUENCE LISTINGS

The invention can be more fully understood from the following detailed description and the accompanying drawings and Sequence Listing, which form a part of this application.

FIG. 1 provides plasmid maps for pFBAIn-YLDGAT1, for pFBAIn-YLDGAT2, and for pFBAIn-MOD1.

FIG. 2 provides plasmid maps for KS352 and KS332.

Figure 3B:
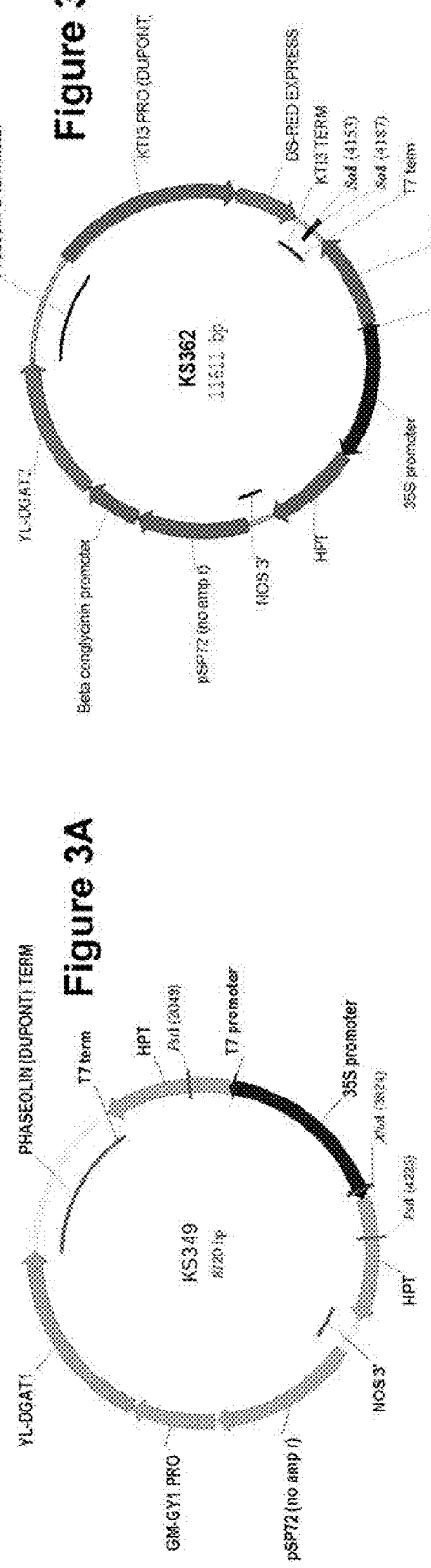
Figure 3C:
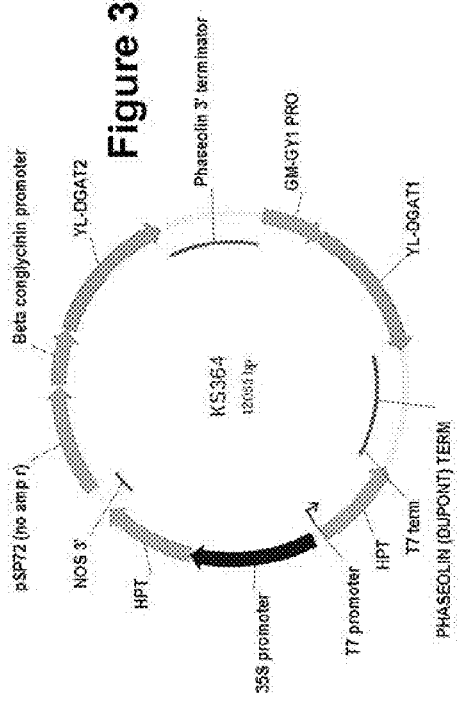

FIG. 3 provides plasmid maps for KS349, KS362, and KS364.

FIG. 4 provides provides a strong correlation ($R^2 \geq 0.59$) between the oleic acid content and the total esterified fatty acid content for somatic embryos generated with KS349.

FIG. 5 provides a strong correlation ($R^2 \geq 0.67$) between the oleic acid content and the total esterified fatty acid content for somatic embryos generated with KS362 alone or in combination with KS349 as well as with KS364.

Figure 6A:
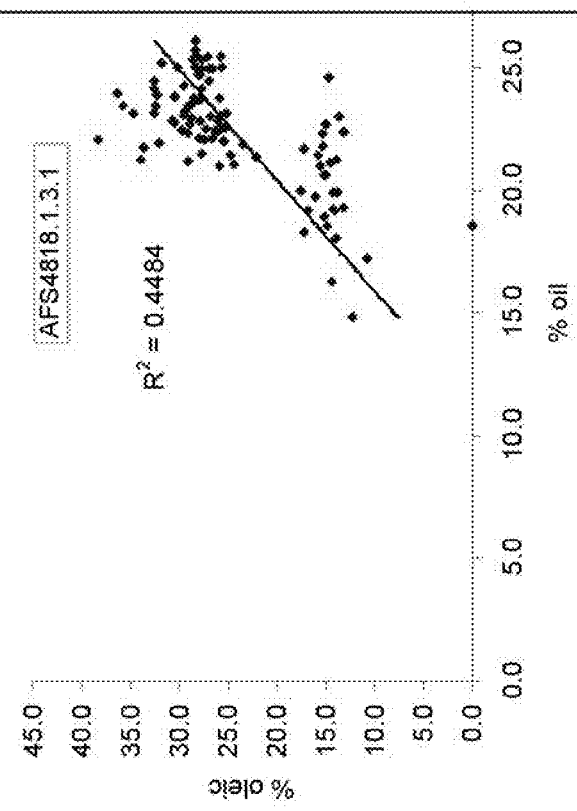
Figure 6B:
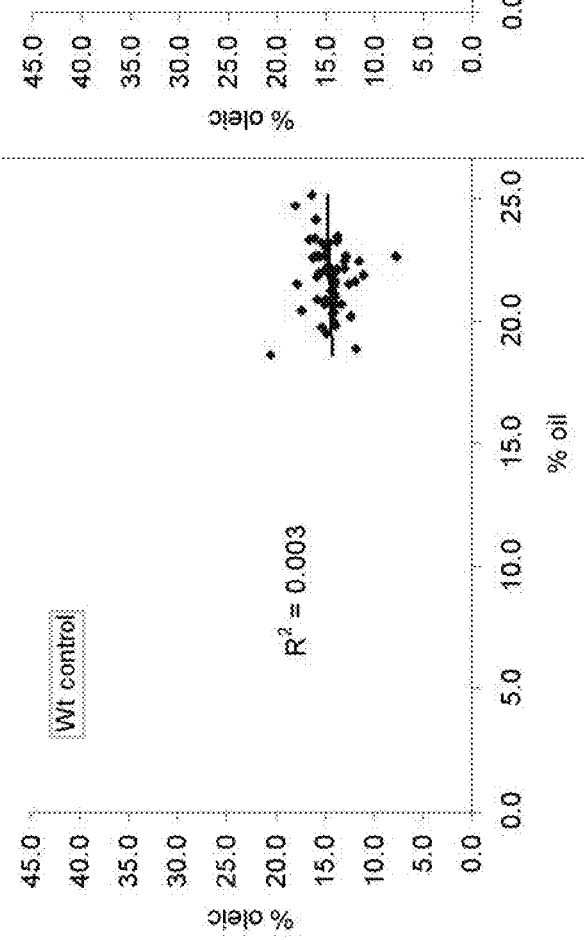

FIG. 6 provides provides a correlation ($R^2 \geq 0.45$) between the oleic acid content and the oil content for transgenic soy seed (T1 generation) generated by co-transformation of plasmids KS349 and KS362.

FIG. 7 provides oil content and seed weight of T1 seed generated by co-transformation of plasmids KS349 and KS362 (A) and KS362 alone (B).

FIG. 8 provides hybridization results from genomic DNA blots. Genomic DNA was isolated from transgenic soybeans obtained from events AFS4818.1.2, AFS4818.1.3, AFS4818.1.5, AFS48182.6, AFS4818.1.9 (See Example 6). DNA was digested with EcoRI or HindIII and run out on a gel and blotted to nylon filters [AFS4818.1.2 lanes 1 and 2, AFS4818.1.3 lanes 3 and 4, AFS4818.1.5 lanes 5 and 6, AFS48182.6 lanes 7 and 8, AFS4818.1.9 lanes 9 and 10, and lanes 11 and 12 are non-transgenic wild-type DNA also digested with EcoRi and HindIII]. Hybridization probes were a *Yarrowia* DGAT1-specific probe for the upper blot (A) and the lower blot was probed with a *Yarrowia* DGAT2 specific probe.

FIG. 9 provides hybridization results from genomic DNA blots. The blots are similar to those described in FIG. 8 except the DNAs were all digested with BstXI and the blot was probed with a *Yarrowia* DGAT2 specific probe.

The sequence descriptions summarize the Sequences Listing attached hereto. The Sequence Listing contains one letter codes for nucleotide sequence characters and the single and three letter codes for amino acids as defined in the IUPAC-IUB standards described in *Nucleic Acids Research* 13:3021-3030 (1985) and in the *Biochemical Journal* 219(2):345-373 (1984).

Summary Of Nucleic Acid And Protein SEQ ID Numbers

| Description and Abbreviation | Nucleic acid SEQ ID NO. | Protein SEQ ID NO. |
|---|---|---|
| *Yarrowia lipolytica* DGAT1 gene | 1 (1581 bp) | |
| Plasmid pYDA1 | 2 (8325 bp) | |
| Plasmid py75 | 3 (7518 bp) | |
| Plasmid pY75 YLDGAT1: YLDGAT1 inserted into pY75 | 4 (9109) | |
| Plasmid pRS425 | 5 (6849 bp) | |
| Plasmid pGDP425 | 6 (7494 bp) | |
| *Yarrowia lipolytica* DGAT2 gene | 9 (1545 bp) | 10 (514 aa) |
| Plasmid pY75 YLDGAT2, pY75 with YL DGAT2 inserted | 11 (9070 bp) | |
| *Yarrowia lipolytica* DGAT1 gene variant with NcoI and NotI sites added | 16 (1603 bp) | |
| *Yarrowia lipolytica* DGAT2 gene variant with NcoI and NotI sites added | 17 (1567 bp) | |
| Plasmid pFBAIN-MOD-1 | 18 (6991 bp) | |
| Plasmid pFBAIN-YLDGAT, pFBAIN with YL DGAT1 inserted | 19 (8568 bp) | |
| Plasmid pFBAIN-YLDGAT2 | 20 (8532 bp) | |
| Plasmid pKS123 | 21 (7049 bp) | |
| cal a24-4 | 22 (1098 bp) | |
| Plasmid pKR53B | 25 (8138 bp) | |
| Plasmid pKR72 | 26 (7085 bp) | |
| Plasmid pKR85 | 27 (7085 bp) | |
| Plasmid pPCR85 | 30 (4827 bp) | |
| Plasmid pKR91 | 31 (15114 bp) | |
| Plasmid pKR92 | 32 (13268 bp) | |
| Plasmid pKR92 YL DGAT2, pKR92 with the YL DGAT2 gene inserted | 33 (19604 bp) | |
| Plasmid pKR92 YL DGAT1 YL DGAT2 | 34 (20082 bp) | |
| Soybean glycinin 1 (GY1) gene (Genbank X15121) | 35 (3527 bp) | |
| Soybean GY1 promoter | 36 (690 bp) | |
| Plasmid pZBL114 | 39 (6660 bp) | |
| Soybean GM GY1 (glycinin 1) gene | 40 (1437 bp) | |

Summary Of Nucleic Acid And Protein SEQ ID Numbers -continued

| Description and Abbreviation | Nucleic acid SEQ ID NO. | Protein SEQ ID NO. |
|---|---|---|
| Synthetic BHL8 (barley high lysine) gene | 41 (204 bp) | |
| GY1-BHL8 fusion product | 42 (1701 bp) | |
| Plasmid pZBL133 | 43 (6493 bp) | |
| Plasmid pKS238 | 44 (6472 bp) | |
| Plasmid pKS240 | 45 (6259 bp) | |
| Plasmid pKS120 | 46 (5267 bp) | |
| Plasmid pKS242 | 47 (8643 bp) | |
| Plasmid pKS349 | 48 (8720 bp) | |
| Plasmid pKS121/BS | 49 (5280 bp) | |
| Plasmid pDs-Red in pKS121/BS | 50 (5968 bp) | |
| Plasmid pKS332 | 51 (10058 bp) | |
| Plasmid pKS362 comprising wild-type *Yarrowia lipolytica* DGAT2 driven by a beta-conglycinin promoter | 52 (11611 bp) | |
| Soybean promoter GM P34 | 53 (1422 bp) | |
| Plasmid pZBL115 | 56 (7466 bp) | |
| Plasmid pJS89 | 57 (7841 bp) | |
| *Morteriella alpina* delta-6 desaturase gene coding sequence | 58 (1390 bp) | |
| Plasmid pJS93 | 59 (9223 bp) | |
| Plasmid pKS127 | 60 (7472 bp) | |
| Plasmid pKS343 | 61 (7847 bp) | |
| Plasmid pKS352 | 62 (10866 bp) | |
| Plasmid pKS364 | 63 (12055 bp) | |
| *Yarrowia lipolytica* DGAT1 gene codon optimized for soybean | 64 (1581 bp) | 65 (526 aa) |
| *Yarrowia lipolytica* DGAT2 gene codon optimized for soybean | 66 (1545 bp) | 67 (514 aa) |
| Plasmid pKR1234 | 68 (8638 bp) | |
| Plasmid ppPSgly32 | 71 (3673 bp) | |
| Plasmid pKR264 | 72 (4171 bp) | |
| Plasmid pKR1212 | 73 (6130 bp) | |
| Plasmid pKR1235 | 74 (5764 bp) | |
| Plasmid pKR1236 comprising both *Yarrowia lipolytica* DGAT1 and DGAT2 | 75 (11693 bp) | |
| Plasmid pKR1254 comprising wild-type *Yarrowia lipolytica* DGAT2 | 78 (5079 bp) | |
| Plasmid pKR1254_Y326F, pKR1254 comprising mutant Y326F *Yarrowia lipolytica* DGAT2 | 81 (5079 bp) | |
| *Yarrowia lipolytica* DGAT2 comprising codon 326 mutated from Tyr to Phe | 82 (1545 bp) | 83 (514 aa) |
| Plasmid pKR1254_Y326L, pKR1254 comprising mutant Y326L *Yarrowia lipolytica* DGAT2 | 86 (5079 bp) | |
| *Yarrowia lipolytica* DGAT2 comprising codon 326 mutated from Tyr to Leu | 87 (1545 bp) | 88 (514 aa) |
| Plasmid pKR1254_R327K, pKR1254 comprising mutant R327K *Yarrowia lipolytica* DGAT2 | 91 (5079 bp) | |

-continued

Summary Of Nucleic Acid And Protein SEQ ID Numbers

| Description and Abbreviation | Nucleic acid SEQ ID NO. | Protein SEQ ID NO. |
|---|---|---|
| *Yarrowia lipolytica* DGAT2 comprising codon 327 mutated from Arg to Lys | 92 (1545 bp) | 93 (514 aa) |
| Plasmid pY191 yeast expression vector comprising wild-type *Yarrowia lipolytica* DGAT2 | 94 (9074 bp) | |
| Plasmid pY192 yeast expression vector comprising mutant Y326F *Yarrowia lipolytica* DGAT2 | 95 (9074 bp) | |
| Plasmid pY193 yeast expression vector comprising mutant Y326L *Yarrowia lipolytica* DGAT2 | 96 (9074 bp) | |
| Plasmid pY194 yeast expression vector comprising mutant R327K *Yarrowia lipolytica* DGAT2 | 97 (9074 bp) | |
| Plasmid pKR1256 soybean expression vector comprising wild-type *Yarrowia lipolytica* DGAT2 | 98 (8641 bp) | |
| Plasmid pKR1277 soybean expression vector comprising mutant Y326F *Yarrowia lipolytica* DGAT2 | 99 (8641 bp) | |
| Plasmid pKR1278 soybean expression vector comprising mutant Y326L *Yarrowia lipolytica* DGAT2 | 100 (8641 bp) | |
| Plasmid pKS392 comprising *Yarrowia lipolytica* DGAT1 codon optimized for soybean driven by b-conglycinin promoter | 101 (11647 bp) | |
| Plasmid pKS393 comprising *Yarrowia lipolytica* DGAT2 codon optimized for soybean driven by b-con promoter | 102 (11611 bp) | |
| Plasmid pKS391 comprising wild-type *Yarrowia lipolytica* DGAT1 driven by b-con promoter | 103 (11649 bp) | |
| plasmid pKR278 | 104 (5303) | |
| plasmid pKR1274 | 105 (8358) | |
| Soybean thioesterase2 gene | 106 (1251) | |
| plasmid pTC4 | 107 (9592) | |
| plasmid pKR1258 | 112 (4738) | |
| Soybean Fad 2-1 gene | 113 (1164) | |
| plasmid pBS43 | 114 (10303) | |
| plasmid PCRblunt-Fad2-1 | 119 (4584) | |
| plasmid pKR1259 | 120 (5797) | |
| plasmid pKR1261 | 121 (7590) | |
| plasmid pKR123R | 122 (4993) | |
| plasmid pKR1266 | 123 (9036) | |
| plasmid pKR1267 | 124 (11615) | |
| plasmid pKR457 | 125 (5252) | |
| plasmid pKR1264 | 126 (9295) | |
| plasmid pKR1277 | 127 (2577) | |
| plasmid pKR1269 | 128 (9219) | |

SEQ ID NOs:7-8 correspond to PCR primers oYLD-GAT2-1 (SEQ IOD NO:7) and oYLDGAT2-2 (SEQ IOD NO:8), used to amplify the *Yarrowia lipolytica* diacylglycerol acyltransferase 2 (YL DGAT2) gene from a yeast lysate (for details see Example 1.)

SEQ ID NOs:12-15 correspond to oligonucleotide primers used to amplify the coding regions of YL DGAT1 (YD-GAT1-F and YDGAT1-R; SEQ ID NOs:12-13, respectively) and YL DGAT2 (YDGAT2-F and YDGAT2-R, SEQ ID NOs: 14-15, respectively) from *Yarrowia lipolytica* genomic DNA.

SEQ ID NOs:23 (oCal-15) and SEQ ID NO:24 (oCal-6) correspond to oligonucleotide primers used to amplify DNA fragment cal a24-4 (SEQ ID NO:22) from template plasmid CalFad2-2 described in PCT Publication No. WO 02/008269.

SEQ ID NO:28 (oKR85-1) and SEQ ID NO:29 (oKR85-2) correspond to primers used to amplify the beta-conglycinin promoter-(NotI cloning site)-phaseolin 3' terminator region from plasmid pKR85 (SEQ ID NO:27.)

SEQ ID NOs:37 (oGy1-1) and SEQ ID NO:38 (oGy1-2) correspond to primers used to amplify the soybean glycinin 1 promoter (SEQ ID NO:36) and incorporating BamHI and NcoI sites on the 5' and 3'-ends, respectively.

SEQ ID NO:54 (oP34-1) and SEQ ID NO:55 (oP34-2) correspond to primers used to amplify the soybean P34 promoter (SEQ ID NO:53) and incorporating BamHI and NotI sites into the 5' and 3'-ends, respectively.

SEQ ID NO:69 (oSGly-2) and SEQ ID NO:70 (oSGly-3) correspond to primers used to amplify the glycinin GY1 promoter.

SEQ ID NOs:76 (oYDG2-1) and SEQ ID NO:77 (oYDG2-2) correspond to primers used to amplify *Yarrowia* DGAT2 (SEQ ID NO:10) which was then incorporated into pKR1254 (SEQ ID NO:78).

SEQ ID NO:79 (YID2_Y326F-5) and SEQ ID NO:80 (YID2_Y326F-3) correspond to primers used to mutate the amino acid at position 326 of *Yarrowia* DGAT2 (SEQ ID NO:10) from tyrosine to phenylalanine.

SEQ ID NO:84 (YID2_Y326L-5) and SEQ ID NO:85 (YID2_Y326L-3) correspond to primers used to mutate the amino acid at position 326 of *Yarrowia* DGAT2 (SEQ ID NO:10) from tyrosine to leucine.

SEQ ID NO:89 (YID2_R327K-5) and SEQ ID NO:90 (YID2_R327K-3) correspond to primers used to mutate the amino acid at position 327 of *Yarrowia* DGAT2 (SEQ ID NO:10) from arginine to lysine.

SEQ ID NO:108-111 (GmTE2 5-1, GmTE2 3-1, GmTE2 5-2, and GmTE2 3-2, respectively) correspond to primers used to amplify the soybean thioesterase 2 gene.

SEQ ID NO:115-118 (GmFad2-1 5-1, GmFad2-1 3-1, GmFad2-1 5-2, and GmFad2-1 3-2, respectively) correspond to primers used to amplify the soybean fatty acid desaturase 2-1 gene.

DETAILED DESCRIPTION OF THE INVENTION

The disclosure of each reference set forth herein is hereby incorporated by reference in its entirety.

As used herein and in the appended claims, the singular forms "a", "an", and "the" include plural reference unless the context clearly dictates otherwise. Thus, for example, reference to "a plant" includes a plurality of such plants, reference to "a cell" includes one or more cells and equivalents thereof known to those skilled in the art, and so forth.

In the context of this disclosure, a number of terms and abbreviations are used. The following definitions are provided.

"Open reading frame" is abbreviated ORF.
"Polymerase chain reaction" is abbreviated PCR.
"American Type Culture Collection" is abbreviated ATCC.
Acyl-CoA:sterol-acyltransferase" is abbreviated ARE2.
"Phospholipid:diacylglycerol acyltransferase" is abbreviated PDAT.

"Diacylglycerol acyltransferase" is abbreviated DAG AT or DGAT.

"Diacylglycerol" is abbreviated DAG.

"Triacylglycerols" are abbreviated TAGs.

"Co-enzyme A" is abbreviated CoA.

The term "fatty acids" refers to long chain aliphatic acids (alkanoic acids) of varying chain length, from about $C_{12}$ to $C_{22}$ (although both longer and shorter chain-length acids are known). The predominant chain lengths are between $C_{16}$ and $C_{22}$. The structure of a fatty acid is represented by a simple notation system of "X:Y", where X is the total number of carbon (C) atoms in the particular fatty acid and Y is the number of double bonds.

Generally, fatty acids are classified as saturated or unsaturated. The term "saturated fatty acids" refers to those fatty acids that have no "double bonds" between their carbon backbone. In contrast, "unsaturated fatty acids" have "double bonds" along their carbon backbones (which are most commonly in the cis-configuration). "Monounsaturated fatty acids" have only one "double bond" along the carbon backbone (e.g., usually between the $9^{th}$ and $10^{th}$ carbon atom as for palmitoleic acid (16:1) and oleic acid (18:1)), while "polyunsaturated fatty acids" (or "PUFAs") have at least two double bonds along the carbon backbone (e.g., between the $9^{th}$ and $10^{th}$, and $12^{th}$ and $13^{th}$ carbon atoms for linoleic acid (18:2); and between the $9^{th}$ and $10^{th}$, $12^{th}$ and $13^{th}$, and $15^{th}$ and $16^{th}$ for α-linolenic acid (18:3)).

"Microbial oils" or "single cell oils" are those oils naturally produced by microorganisms (e.g., algae, oleaginous yeasts and filamentous fungi) during their lifespan. The term "oil" refers to a lipid substance that is liquid at 25° C. and usually polyunsaturated. In contrast, the term "fat" refers to a lipid substance that is solid at 25° C. and usually saturated.

"Lipid bodies" refer to lipid droplets that usually are bounded by specific proteins and a monolayer of phospholipid. These organelles are sites where most organisms transport/store neutral lipids. Lipid bodies are thought to arise from microdomains of the endoplasmic reticulum that contain TAG-biosynthesis enzymes; and, their synthesis and size appear to be controlled by specific protein components.

"Neutral lipids" refer to those lipids commonly found in cells in lipid bodies as storage fats and oils and are so called because at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or TAG, respectively (or collectively, acylglycerols). A hydolysis reaction must occur to release free fatty acids from acylglycerols.

The terms "triacylglycerol", "oil" and "TAGs" refer to neutral lipids composed of three fatty acyl residues esterified to a glycerol molecule (and such terms will be used interchangeably throughout the present disclosure herein). Such oils can contain long chain PUFAs, as well as shorter saturated and unsaturated fatty acids and longer chain saturated fatty acids. Thus, "oil biosynthesis" generically refers to the synthesis of TAGs in the cell.

The term "DAG AT" refers to a diacylglycerol acyltransferase (also known as an acyl-CoA-diacylglycerol acyltransferase or a diacylglycerol O-acyltransferase) (EC 2.3.1.20). This enzyme is responsible for the conversion of acyl-CoA and 1,2-diacylglycerol to TAG and CoA (thereby involved in the terminal step of TAG biosynthesis). Two families of DAG AT enzymes exist: DGAT1 and DGAT2. The former family shares homology with the acyl-CoA:cholesterol acyltransferase (ACAT) gene family, while the latter family is unrelated (Lardizabal et al., *J. Biol. Chem.* 276(42):38862-28869 (2001)).

The term "PDAT" refers to a phospholipid:diacylglycerol acyltransferase enzyme (EC 2.3.1.158). This enzyme is responsible for the transfer of an acyl group from the sn-2 position of a phospholipid to the sn-3 position of 1,2-diacylglycerol, thus resulting in lysophospholipid and TAG (thereby involved in the terminal step of TAG biosynthesis). This enzyme differs from DGAT (EC 2.3.1.20) by synthesizing TAG via an acyl-CoA-independent mechanism.

The term "ARE2" refers to an acyl-CoA:sterol-acyltransferase enzyme (EC 2.3.1.26; also known as a sterol-ester synthase 2 enzyme), catalyzing the following reaction: acyl-CoA+cholesterol=CoA+cholesterol ester.

As used herein, "nucleic acid" means a polynucleotide and includes single or double-stranded polymer of deoxyribonucleotide or ribonucleotide bases. Nucleic acids may also include fragments and modified nucleotides. Thus, the terms "polynucleotide", "nucleic acid sequence", "nucleotide sequence" or "nucleic acid fragment" are used interchangeably and is a polymer of RNA or DNA that is single- or double-stranded, optionally containing synthetic, non-natural or altered nucleotide bases. Nucleotides (usually found in their 5'-monophosphate form) are referred to by their single letter designation as follows: "A" for adenylate or deoxyadenylate (for RNA or DNA, respectively), "C" for cytidylate or deosycytidylate, "G" for guanylate or deoxyguanylate, "U" for uridlate, "T" for deosythymidylate, "R" for purines (A or G), "Y" for pyrimidiens (C or T), "K" for G or T, "H" for A or C or T, "I" for inosine, and "N" for any nucleotide.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of chimeric genes to produce the desired phenotype in a transformed plant. Chimeric genes can be designed for use in suppression by linking a nucleic acid fragment or subfragment thereof, whether or not it encodes an active enzyme, in the sense or antisense orientation relative to a plant promoter sequence.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

The terms "homology", "homologous", "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that substantially similar nucleic acid sequences encompassed by this invention are also defined by their ability to hybridize (under moderately stringent conditions, e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the $T_m$ can be approximated from the equation of Meinkoth et al., *Anal. Biochem.* 138:267-284 (1984): $T_m=81.5°$ C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, N.Y. (1993); and *Current Protocols in Molecular Biology*, Chapter 2, Ausubel et al., Eds., Greene Publishing and Wiley-Interscience, New York (1995). Hybridization and/or wash conditions can be applied for at least 10, 30, 60, 90, 120, or 240 minutes.

"Sequence identity" or "identity" in the context of nucleic acid or polypeptide sequences refers to the nucleic acid bases or amino acid residues in two sequences that are the same when aligned for maximum correspondence over a specified comparison window.

Thus, "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90%, or 95%, or any integer percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, Wis.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, *CABIOS.* 5:151-153 (1989); Higgins, D. G. et al. (1992) *Comput. Appl. Biosci.* 8:189-191) and found in the MegAlign™ program of the LASERGENE bioinformatics computing suite (DNASTAR Inc., Madison, Wis.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program.

"BLASTN method of alignment" is an algorithm provided by the National Center for Biotechnology Information (NCBI) to compare nucleotide sequences using default parameters.

It is well understood by one skilled in the art that many levels of sequence identity are useful in identifying polypeptides, from other species, wherein such polypeptides have the same or similar function or activity. Useful examples of percent identities include, but are not limited to, 50%, 55%, 60%, 65%, 70%, 75%, 80%, 85%, 90%, or 95%, or any integer percentage from 50% to 100%. Indeed, any integer amino acid identity from 50% to 100% may be useful in describing the present invention, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Also, of interest is any full-length or partial complement of this isolated nucleotide fragment.

"Gene" refers to a nucleic acid fragment that expresses a specific protein, including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

The term "genome" as it applies to a plant cells encompasses not only chromosomal DNA found within the nucleus, but organelle DNA found within subcellular components (e.g., mitochondrial, plastid) of the cell.

A "codon-optimized gene" is a gene having its frequency of codon usage designed to mimic the frequency of preferred codon usage of the host cell.

An "allele" is one of several alternative forms of a gene occupying a given locus on a chromosome. When all the alleles present at a given locus on a chromosome are the same that plant is homozygous at that locus. If the alleles present at a given locus on a chromosome differ that plant is heterozygous at that locus.

"Coding sequence" refers to a DNA sequence that codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to: promoters, translation leader sequences, introns, polyadenylation recognition sequences, RNA processing sites, effector binding sites and stem-loop structures.

"Promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity. Promoters that cause a gene to be expressed in most cell types at most times are commonly referred to as "constitutive promoters". New promoters of various types useful in plant cells are constantly being discovered; numerous examples may be found in the compilation by Okamuro, J. K., and Goldberg, R. B. *Biochemistry of Plants* 15:1-82 (1989).

"Translation leader sequence" refers to a polynucleotide sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences have been described (Turner, R. and Foster, G. D., *Mol. Biotechnol.* 3:225-236 (1995)).

"3' non-coding sequences", "transcription terminator" or "termination sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht, I. L., et al. *Plant Cell* 1:671-680 (1989).

"RNA transcript" refers to the product resulting from RNA polymerase-catalyzed transcription of a DNA sequence. When the RNA transcript is a perfect complementary copy of the DNA sequence, it is referred to as the primary transcript. A RNA transcript is referred to as the mature RNA when it is a RNA sequence derived from post-transcriptional processing of the primary transcript. "Messenger RNA" or "mRNA" refers to the RNA that is without introns and that can be translated into protein by the cell. "cDNA" refers to a DNA that is complementary to, and synthesized from, a mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks the expression of a target gene (U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., the coding sequence is under the transcriptional control of the promoter). Coding sequences can be operably linked to regulatory sequences in a sense or antisense orientation. In another example, the complementary RNA regions of the invention can be operably linked, either directly or indirectly, 5' to the target mRNA, or 3' to the target mRNA, or within the target mRNA, or a first complementary region is 5' and its complement is 3' to the target mRNA.

Standard recombinant DNA and molecular cloning techniques used herein are well known in the art and are described more fully in Sambrook, J., Fritsch, E. F. and Maniatis, T. Molecular Cloning: A Laboratory Manual; Cold Spring Harbor Laboratory: Cold Spring Harbor, N.Y. (1989). Transformation methods are well known to those skilled in the art and are described infra.

"PCR" or "polymerase chain reaction" is a technique for the synthesis of large quantities of specific DNA segments and consists of a series of repetitive cycles (Perkin Elmer Cetus Instruments, Norwalk, Conn.). Typically, the double-stranded DNA is heat denatured, the two primers complementary to the 3' boundaries of the target segment are annealed at low temperature and then extended at an intermediate temperature. One set of these three consecutive steps is referred to as a "cycle".

The term "recombinant" refers to an artificial combination of two otherwise separated segments of sequence, e.g., by chemical synthesis or by the manipulation of isolated segments of nucleic acids by genetic engineering techniques.

The terms "plasmid", "vector" and "cassette" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host (i.e., to a discrete nucleic acid fragment into which a nucleic acid sequence or fragment can be moved.)

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al., *EMBO J.* 4:2411-2418 (1985); De Almeida et al., *Mol. Gen. Genetics* 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

The term "expression", as used herein, refers to the production of a functional end-product (e.g., a mRNA or a protein [either precursor or mature]).

The term "introduced" means providing a nucleic acid (e.g., expression construct) or protein into a cell. Introduced includes reference to the incorporation of a nucleic acid into a eukaryotic or prokaryotic cell where the nucleic acid may be incorporated into the genome of the cell, and includes reference to the transient provision of a nucleic acid or protein to the cell. Introduced includes reference to stable or transient transformation methods, as well as sexually crossing. Thus, "introduced" in the context of inserting a nucleic acid fragment (e.g., a recombinant DNA construct/expression construct) into a cell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid or mitochondrial DNA), converted into an autonomous replicon, or transiently expressed (e.g., transfected mRNA).

"Mature" protein refers to a post-translationally processed polypeptide (i.e., one from which any pre- or propeptides present in the primary translation product have been removed). "Precursor" protein refers to the primary product of translation of mRNA (i.e., with pre- and propeptides still present). Pre- and propeptides may be but are not limited to intracellular localization signals.

"Stable transformation" refers to the transfer of a nucleic acid fragment into a genome of a host organism, including both nuclear and organellar genomes, resulting in genetically stable inheritance. In contrast, "transient transformation" refers to the transfer of a nucleic acid fragment into the nucleus, or DNA-containing organelle, of a host organism resulting in gene expression without integration or stable inheritance. Host organisms containing the transformed nucleic acid fragments are referred to as "transgenic" organisms.

As used herein, "transgenic" refers to a plant or a cell which comprises within its genome a heterologous polynucleotide. Preferably, the heterologous polynucleotide is stably integrated within the genome such that the polynucleotide is passed on to successive generations. The heterologous polynucleotide may be integrated into the genome alone or as part of an expression construct. Transgenic is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

"Antisense inhibition" refers to the production of antisense RNA transcripts capable of suppressing the expression of the target protein. "Co-suppression" refers to the production of sense RNA transcripts capable of suppressing the expression of identical or substantially similar foreign or endogenous genes (U.S. Pat. No. 5,231,020). Co-suppression constructs in plants previously have been designed by focusing on overexpression of a nucleic acid sequence having homology to an endogenous mRNA, in the sense orientation, which results in the reduction of all RNA having homology to the overexpressed sequence (Vaucheret et al., *Plant J.* 16:651-659 (1998); Gura, *Nature* 404:804-808 (2000)). The overall efficiency of this phenomenon is low, and the extent of the RNA reduction is widely variable. More recent work has described the use of "hairpin" structures that incorporate all, or part, of an mRNA encoding sequence in a complementary orientation that results in a potential "stem-loop" structure for the expressed RNA (PCT Publication No. WO 99/53050, published Oct. 21, 1999; PCT Publication No. WO 02/00904, published Jan. 3, 2002). This increases the frequency of co-suppression in the recovered transgenic plants. Another variation describes the use of plant viral sequences to direct the suppression, or "silencing", of proximal mRNA encoding sequences (PCT Publication No. WO 98/36083, published Aug. 20, 1998). Both of these co-suppressing phenomena have not been elucidated mechanistically, although genetic evidence has begun to unravel this complex situation (Elmayan et al., *Plant Cell* 10:1747-1757 (1998)).

The term "oleaginous" refers to those organisms that tend to store their energy source in the form of lipid (Weete, In: Fungal Lipid Biochemistry, 2$^{nd}$ Ed., Plenum, 1980). A class of plants identified as oleaginous are commonly referred to as "oilseed" plants. Examples of oilseed plants include, but are not limited to: soybean (*Glycine* and *Soja* sp.), flax (*Linum* sp.), rapeseed (*Brassica* sp.), maize, cotton, safflower (*Carthamus* sp.) and sunflower (*Helianthus* sp.).

Within oleaginous microorganisms the cellular oil or TAG content generally follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.* 57:419-25 (1991)).

The term "oleaginous yeast" refers to those microorganisms classified as yeasts that make oil. It is not uncommon for oleaginous microorganisms to accumulate in excess of about 25% of their dry cell weight as oil. Examples of oleaginous yeast include, but are no means limited to, the following genera: *Yarrowia, Candida, Rhodotorula, Rhodosporidium, Cryptococcus, Trichosporon* and *Lipomyces*.

The term "plant" refers to whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores.

"Progeny" comprises any subsequent generation of a plant.

"Non-transgenic, null segregant soybean seed" refers to a near isogenic plant or seed that lacks the transgene, and/or a parental plant used in the transformation process to obtain the transgenic event. Null segregants can be plants or seed that do not contain the transgenic trait due to normal genetic segregation during propagation of the heterozygous transgenic plants.

A "kernel" is the corn caryopsis, consisting of a mature embryo and endosperm which are products of double fertilization. The term "corn" or ""maize"" represents any variety, cultivar, or population of *Zea mays* L.

"Grain" comprises mature corn kernels produced by commercial growers for on farm use or for sale to customers in both cases for purposes other than growing or reproducing the species. The "seed" is the mature corn kernel produced for the purpose of propagating the species and for sale to commercial growers. As used herein the terms seeds, kernels, and grains can be used interchangeably. The "embryo" or also termed "germ" is a young sporophytic plant, before the start of a period of rapid growth (seed germination). The embryo (germ) of corn contains the vast majority of the oil found in the kernel. The structure of embryo in cereal grain includes the embryonic axis and the scutellum. The "scutellum" is the single cotyledon of a cereal grain embryo, specialized for absorption of the endosperm. The "aleurone" is a proteinaceous material, usually in the form of small granules, occurring in the outermost cell layer of the endosperm of corn and other grains.

The present invention concerns a transgenic soybean seed having increased total fatty acid content of at least 10% when compared to the total fatty acid content of a non-transgenic, null segregant soybean seed. It is understood that any measurable increase in the total fatty acid content of a transgenic versus a non-transgenic, null segregant would be useful. Such increases in the total fatty acid content would include, but are not limited to, at least 1%, 2%, 3%, 4%, 5%, 6%, 7%, 8%, 9%, 11%, 12%, 13%, 14%, 15%, 16%, 17%, 18%, 19%, or 20%.

A transgenic oilseed of the invention can comprise a recombinant construct having at least one DGAT sequence. This DGAT sequence can be selected from the group consisting of DGAT1, DGAT2 and DGAT1 in combination with DGAT2. Furthermore, at least one DGAT sequence can be from *Yarrowia*. Examples of suitable DGAT sequences that can be used to practice the invention are discussed in the Examples below. There can be mentioned SEQ ID NOs:1, 9, 64, 66, 82, 87, and 92 in the present invention. Those skilled in the art will appreciate that the instant invention includes, but is not limited to, the DGAT sequences disclosed herein.

Such a recombinant construct promoter would comprise different components such as a promoter which is a DNA sequence that directs cellular machinery of a plant to produce RNA from the contiguous coding sequence downstream (3') of the promoter. The promoter region influences the rate, developmental stage, and cell type in which the RNA transcript of the gene is made. The RNA transcript is processed to produce mRNA which serves as a template for translation of the RNA sequence into the amino acid sequence of the encoded polypeptide. The 5' non-translated leader sequence is a region of the mRNA upstream of the protein coding region that may play a role in initiation and translation of the mRNA. The 3' transcription termination/polyadenylation signal is a non-translated region downstream of the protein coding region that functions in the plant cell to cause termination of the RNA transcript and the addition of polyadenylate nucleotides to the 3' end of the RNA.

The origin of the promoter chosen to drive expression of the DGAT coding sequence is not important as long as it has sufficient transcriptional activity to accomplish the invention by expressing translatable mRNA for the desired nucleic acid fragments in the desired host tissue at the right time. Either heterologous or non-heterologous (i.e., endogenous) promoters can be used to practice the invention. For example, suitable promoters include, but are not limited to: the alpha prime subunit of beta conglycinin promoter, the Kunitz trypsin inhibitor 3 promoter, the annexin promoter, the glycinin Gy1 promoter, the beta subunit of beta conglycinin promoter, the P34/Gly Bd m 30K promoter, the albumin promoter, the Leg A1 promoter and the Leg A2 promoter.

The annexin, or P34, promoter is described in PCT Publication No. WO 2004/071178 (published Aug. 26, 2004). The level of activity of the annexin promoter is comparable to that of many known strong promoters, such as: (1) the CaMV 35S promoter (Atanassova et al., *Plant Mol. Biol.* 37:275-285 (1998); Battraw and Hall, *Plant Mol. Biol.* 15:527-538 (1990); Holtorf et al., *Plant Mol. Biol.* 29:637-646 (1995); Jefferson et al., *EMBO J.* 6:3901-3907 (1987); Wilmink et al., *Plant Mol. Biol.* 28:949-955 (1995)); (2) the *Arabidopsis* oleosin promoters (Plant et al., *Plant Mol. Biol.* 25:193-205 (1994); Li, Texas A&M University Ph.D. dissertation, pp. 107-128 (1997)); (3) the *Arabidopsis* ubiquitin extension protein promoters (Callis et al., *J Biol. Chem.* 265(21):12486-93 (1990)); (4) a tomato ubiquitin gene promoter (Rollfinke et al., *Gene.* 211(2):267-76 (1998)); (5) a soybean heat shock protein promoter (Schoffl et al., *Mol Gen Genet.* 217(2-3):246-53 (1989)); and, (6) a maize H3 histone gene promoter (Atanassova et al., *Plant Mol Biol.* 37(2):275-85 (1989)).

Another useful feature of the annexin promoter is its expression profile in developing seeds. The annexin promoter is most active in developing seeds at early stages (before 10 days after pollination) and is largely quiescent in later stages. The expression profile of the annexin promoter is different from that of many seed-specific promoters, e.g., seed storage protein promoters, which often provide highest activity in later stages of development (Chen et al., *Dev. Genet.* 10:112-122 (1989); Ellerstrom et al., *Plant Mol. Biol.* 32:1019-1027 (1996); Keddie et al., *Plant Mol. Biol.* 24:327-340 (1994); Plant et al., (supra); Li, (supra)). The annexin promoter has a more conventional expression profile but remains distinct from other known seed specific promoters. Thus, the annexin promoter will be a very attractive candidate when overexpression, or suppression, of a gene in embryos is desired at an early developing stage. For example, it may be desirable to overexpress a gene regulating early embryo development or a gene involved in the metabolism prior to seed maturation.

Following identification of an appropriate promoter suitable for expression of a specific DGAT-coding sequence, the promoter is then operably linked in a sense orientation using conventional means well known to those skilled in the art.

Standard recombinant DNA and molecular cloning techniques used herein are well known in the art and are described more fully in Sambrook, J. et al., In *Molecular Cloning: A Laboratory Manual;* 2$^{nd}$ ed.; Cold Spring Harbor Laboratory Press: Cold Spring Harbor, N.Y., 1989 (hereinafter "Sambrook et al., 1989") or Ausubel, F. M., Brent, R., Kingston, R. E., Moore, D. D., Seidman, J. G., Smith, J. A. and Struhl, K., Eds.; In *Current Protocols in Molecular Biology*; John Wiley and Sons: New York, 1990 (hereinafter "Ausubel et al., 1990").

In another aspect, this invention concerns a method method for increasing the total fatty acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% when compared to the total fatty acid content of a non-transgenic, null segregant soybean seed.

Once the recombinant construct has been made, it may then be introduced into a plant cell of choice by methods well known to those of ordinary skill in the art (e.g., transfection, transformation and electroporation). Oilseed plant cells are the preferred plant cells. The transformed plant cell is then cultured and regenerated under suitable conditions permitting selection of those transformed soybean cell(s) having an increased total fatty acid content of at least 10% when compared to the total fatty acid content of a non-transgenic, null segregant soybean seed.

Such recombinant constructs may be introduced into one plant cell; or, alternatively, each construct may be introduced into separate plant cells.

Expression in a plant cell may be accomplished in a transient or stable fashion as is described above.

Also within the scope of this invention are seeds or plant parts obtained from such transformed plants.

Plant parts include differentiated and undifferentiated tissues including, but not limited to the following: roots, stems, shoots, leaves, pollen, seeds, tumor tissue and various forms of cells and culture (e.g., single cells, protoplasts, embryos and callus tissue). The plant tissue may be in plant or in a plant organ, tissue or cell culture.

The term "plant organ" refers to plant tissue or a group of tissues that constitute a morphologically and functionally distinct part of a plant. The term "genome" refers to the following: (1) the entire complement of genetic material (genes and non-coding sequences) that is present in each cell of an organism, or virus or organelle; and/or (2) a complete set of chromosomes inherited as a (haploid) unit from one parent.

Methods for transforming dicots (primarily by use of *Agrobacterium tumefaciens*) and obtaining transgenic plants have been published, among others, for: cotton (U.S. Pat. No. 5,004,863; U.S. Pat. No. 5,159,135); soybean (U.S. Pat. No. 5,569,834; U.S. Pat. No. 5,416,011); *Brassica* (U.S. Pat. No. 5,463,174); peanut (Cheng et al. *Plant Cell Rep.* 15:653-657 (1996); McKently et al. *Plant Cell Rep.* 14:699-703 (1995)); papaya (Ling, K. et al. *Bio/technology* 9:752-758 (1991)); and pea (Grant et al. *Plant Cell Rep.* 15:254-258 (1995)). For a review of other commonly used methods of plant transformation see Newell, C. A. (*Mol. Biotechnol.* 16:53-65 (2000)). One of these methods of transformation uses *Agrobacterium rhizogenes* (Tepfler, M. and Casse-Delbart, F. *Microbiol. Sci.* 4:24-28 (1987)). Transformation of soybeans using direct delivery of DNA has been published using PEG fusion (PCT Publication No. WO 92/17598), electroporation (Chowrira, G. M. et al., *Mol. Biotechnol.* 3:17-23 (1995); Christou, P. et al., *Proc. Natl. Acad. Sci.* U.S.A. 84:3962-3966 (1987)), microinjection and particle bombardment (McCabe, D. E. et. al., *Bio/Technology* 6:923 (1988); Christou et al., *Plant Physiol.* 87:671-674 (1988)).

There are a variety of methods for the regeneration of plants from plant tissue. The particular method of regeneration will depend on the starting plant tissue and the particular plant species to be regenerated. The regeneration, development and cultivation of plants from single plant protoplast transformants or from various transformed explants is well known in the art (Weissbach and Weissbach, In: Methods for Plant Molecular Biology, (Eds.), Academic: San Diego, Calif. (1988)). This regeneration and growth process typically includes the steps of selection of transformed cells and culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

In addition to the above discussed procedures, practitioners are familiar with the standard resource materials which describe specific conditions and procedures for: the construction, manipulation and isolation of macromolecules (e.g., DNA molecules, plasmids, etc.); the generation of recombinant DNA fragments and recombinant expression constructs; and, the screening and isolating of clones. See, for example: Sambrook et al., Molecular Cloning: A Laboratory Manual, Cold Spring Harbor: N.Y. (1989); Maliga et al., Methods in Plant Molecular Biology, Cold Spring Harbor: N.Y. (1995); Birren et al., Genome Analysis: Detecting Genes, Vol. 1, Cold Spring Harbor: N.Y. (1998); Birren et al., Genome Analysis: Analyzing DNA, Vol. 2, Cold Spring Harbor: N.Y. (1998); Plant Molecular Biology: A Laboratory Manual, eds. Clark, Springer: N.Y. (1997).

Examples of oilseed plants include, but are not limited to: soybean, *Brassica* species, sunflower, maize, cotton, flax and safflower.

In another aspect, this invention concerns a a transgenic corn kernel having increased total fatty acid content of at least 10% when compared to the total fatty acid content of a non-transgenic, null segregant corn kernel. Such a transgenic corn kernel can comprise a recombinant construct having at least one DGAT sequence. This DGAT sequence can be selected from the group consisting of DGAT1, DGAT2, or DGAT1 in combination with DGAT2.

In still another aspect, the present invention concerns a method for increasing the total fatty acid content of a corn kernel comprising:
(a) transforming at least one corn kernel with a recombinant construct having at least one DGAT sequence;
(b) selecting the transformed corn kernel(s) of step (a) having an increased total fatty acid content of at least 10% when compared to the total fatty acid content of a non-transgenic, null segregant corn kernel.

The present invention also concerns a transgenic soybean seed having increased total fatty acid content of at least 10% and an increased oleic acid content of at least 25% when compared to the total fatty acid content and oleic acid content of a non-transgenic, null segregant soybean seed. And the present invention further concerns a transgenic soybean having increased total fatty acid content of at least 10% and at least any one of i) an increased oleic acid content of at least 25%; ii) a decreased linolenic acid content of at least 25%; iii) a decreased linoleic acid content of at least 4%; iv) a decreased palmitic acid content of at least 8%; and v) an increased stearic acid content of at lease 14% when compared to the total fatty acid content and oleic, linolenic acid, linoleic acid, palmitic acid or stearic acid, respectively, content of a non-transgenic, null segragant soybean seed.

In still a further aspect, the present invention also concerns a method for increasing the total fatty acid content and oleic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and an increased oleic acid content of at least 25% when compared to the total fatty acid content and oleic acid content of a non-transgenic, null segregant soybean seed.

In still yet a further aspect, the present invention concerns a method for increasing the total fatty acid content and decreasing linolenic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and a decreased linolenic acid content of at least 25% when compared to the total fatty acid content and oleic acid content of a non-transgenic, null segregant soybean seed.

Yet again in a further aspect, the present invention concerns a method for increasing the total fatty acid content and decreasing linoleic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and a decreased linoleic acid content of at least 4% when compared to the total fatty acid content and oleic acid content of a non-transgenic, null segregant soybean seed.

Again in a further aspect, the present invention concerns a method for increasing the total fatty acid content and decreased palmitic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and a decreased palmitic acid content of at least 8% when compared to the total fatty acid content and oleic acid content of a non-transgenic, null segregant soybean seed.

In yet another aspect, the present invention concerns a method for increasing the total fatty acid content and stearic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and an increased stearic acid content of at least 14% when compared to the total fatty acid content and oleic acid content of a non-transgenic, null segregant soybean seed.

As was discussed above, any of the transgenic oilseeds discussed herein can comprise a recombinant construct having at least one DGAT sequence. This DGAT sequence can be selected from the group consisting of DGAT1, DGAT2, or DGAT1 in combination with DGAT2. Furthermore, at least one DGAT sequence is from *Yarrowia*.

Transformation of monocotyledons using electroporation, particle bombardment, and *Agrobacterium* have been reported. Transformation and plant regeneration have been achieved in asparagus (Bytebier et al., *Proc. Natl. Acad. Sci.*

(USA) 84:5354, (1987)); barley (Wan and Lemaux, *Plant Physiol* 104:37 (1994)); *Zea mays* (Rhodes et al., *Science* 240:204 (1988), Gordon-Kamm et al., *Plant Cell* 2:603-618 (1990), Fromm et al., *Bio/Technology* 8:833 (1990), Koziel et al., *Bio/Technology* 11: 194, (1993), Armstrong et al., *Crop Science* 35:550-557 (1995)); oat (Somers et al., *Bio/Technology* 10: 15 89 (1992)); orchard grass (Horn et al., *Plant Cell Rep.* 7:469 (1988)); rice (Toriyama et al., *TheorAppl. Genet.* 205:34, (1986); Part et al., *Plant Mol. Biol.* 32:1135-1148, (1996); Abedinia et al., *Aust. J. Plant Physiol.* 24:133-141 (1997); Zhang and Wu, *Theor. Appl. Genet.* 76:835 (1988); Zhang et al. *Plant Cell Rep.* 7:379, (1988); Battraw and Hall, *Plant Sci.* 86:191-202 (1992); Christou et al., *Bio/Technology* 9:957 (1991)); rye (De la Pena et al., *Nature* 325:274 (1987)); sugarcane (Bower and Birch, *Plant J.* 2:409 (1992)); tall fescue (Wang et al., *Bio/Technology* 10:691 (1992)), and wheat (Vasil et al., *Bio/Technology* 10:667 (1992); U.S. Pat. No. 5,631,152).

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454-457 (1988); Marcotte et al., *Plant Cell* 1:523-532 (1989); McCarty et al., *Cell* 66:895-905 (1991); Hattori et al., *Genes Dev.* 6:609-618 (1992); Goff et al., *EMBO J.* 9:2517-2522 (1990)).

Transient expression systems may be used to functionally dissect gene constructs (see generally, Maliga et al., Methods in Plant Molecular Biology, Cold Spring Harbor Press (1995)). It is understood that any of the nucleic acid molecules of the present invention can be introduced into a plant cell in a permanent or transient manner in combination with other genetic elements such as vectors, promoters, enhancers etc.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., Molecular Cloning: A Laboratory Manual, Cold Spring Harbor Press (1989); Maliga et al., Methods in Plant Molecular Biology, Cold Spring Harbor Press (1995); Birren et al., Genome Analysis: Detecting Genes, 1, Cold Spring Harbor, N.Y. (1998); Birren et al., Genome Analysis: Analyzing DNA, 2, Cold Spring Harbor, N.Y. (1998); Plant Molecular Biology: A Laboratory Manual, eds. Clark, Springer, N.Y. (1997)).

The transgenic soybean seeds of the invention can be processed to yield soy oil, soy products and/or soy by-products.

"Soy products" can include, but are not limited to, those items listed in Table 1A.

TABLE 1A

Soy Protein Products Derived from Soybean Seeds[a]

| Whole Soybean Products | Processed Soy Protein Products |
|---|---|
| Roasted Soybeans | Full Fat and Defatted Flours |
| Baked Soybeans | Soy Grits |
| Soy Sprouts | Soy Hypocotyls |
| Soy Milk | Soybean Meal |
| Specialty Soy Foods/Ingredients | Soy Milk |
| Soy Milk | Soy Protein Isolates |
| Tofu | Soy Protein Concentrates |
| Tempeh | Textured Soy Proteins |
| Miso | Textured Flours and Concentrates |

TABLE 1A-continued

Soy Protein Products Derived from Soybean Seeds[a]

| Whole Soybean Products | Processed Soy Protein Products |
|---|---|
| Soy Sauce | Textured Concentrates |
| Hydrolyzed Vegetable Protein | Textured Isolates |
| Whipping Protein | |

[a]See Soy Protein Products: Characteristics, Nutritional Aspects and Utilization (1987). Soy Protein Council.

"Processing" refers to any physical and chemical methods used to obtain the products listed in Table 1A and includes, but is not limited to, heat conditioning, flaking and grinding, extrusion, solvent extraction, or aqueous soaking and extraction of whole or partial seeds. Furthermore, "processing" includes the methods used to concentrate and isolate soy protein from whole or partial seeds, as well as the various traditional Oriental methods in preparing fermented soy food products. Trading Standards and Specifications have been established for many of these products (see National Oilseed Processors Association Yearbook and Trading Rules 1991-1992). Products referred to as being "high protein" or "low protein" are those as described by these Standard Specifications. "NSI" refers to the Nitrogen Solubility Index as defined by the American Oil Chemists' Society Method Ac4 41. "KOH Nitrogen Solubility" is an indicator of soybean meal quality and refers to the amount of nitrogen soluble in 0.036 M KOH under the conditions as described by Araba and Dale [(1990) *Poult. Sci.* 69:76-83]. "White" flakes refer to flaked, dehulled cotyledons that have been defatted and treated with controlled moist heat to have an NSI of about 85 to 90. This term can also refer to a flour with a similar NSI that has been ground to pass through a No. 100 U.S. Standard Screen size. "Cooked" refers to a soy protein product, typically a flour, with an NSI of about 20 to 60. "Toasted" refers to a soy protein product, typically a flour, with an NSI below 20. "Grits" refer to defatted, dehulled cotyledons having a U.S. Standard screen size of between No. 10 and 80. "Soy Protein Concentrates" refer to those products produced from dehulled, defatted soybeans by three basic processes: acid leaching (at about pH 4.5), extraction with alcohol (about 55-80%), and denaturing the protein with moist heat prior to extraction with water. Conditions typically used to prepare soy protein concentrates have been described by Pass [(1975) U.S. Pat. No. 3,897,574; Campbell et al., (1985) in New Protein Foods, ed. by Altschul and Wilcke, Academic Press, Vol. 5, Chapter 10, *Seed Storage Proteins*, pp 302-338]. "Extrusion" refers to processes whereby material (grits, flour or concentrate) is passed through a jacketed auger using high pressures and temperatures as a means of altering the texture of the material. "Texturing" and "structuring" refer to extrusion processes used to modify the physical characteristics of the material. The characteristics of these processes, including thermoplastic extrusion, have been described previously [Atkinson (1970) U.S. Pat. No. 3,488,770, Horan (1985) In *New Protein Foods*, ed. by Altschul and Wilcke, Academic Press, Vol. 1A, Chapter 8, pp 367-414]. Moreover, conditions used during extrusion processing of complex foodstuff mixtures that include soy protein products have been described previously [Rokey (1983) *Feed Manufacturing Technology III*, 222-237; McCulloch, U.S. Pat. No. 4,454,804].

TABLE 1B

Generalized Steps for Soybean Oil and Byproduct Production

| Process Step | Process | Impurities Removed and/or By-Products Obtained |
|---|---|---|
| # 1 | soybean seed | |
| # 2 | oil extraction | meal |
| # 3 | Degumming | lecithin |
| # 4 | alkali or physical refining | gums, free fatty acids, pigments |
| # 5 | water washing | soap |
| # 6 | Bleaching | color, soap, metal |
| # 7 | (hydrogenation) | |
| # 8 | (winterization) | stearine |
| # 9 | Deodorization | free fatty acids, tocopherols, sterols, volatiles |
| # 10 | oil products | |

More specifically, soybean seeds are cleaned, tempered, dehulled, and flaked, thereby increasing the efficiency of oil extraction. Oil extraction is usually accomplished by solvent (e.g., hexane) extraction but can also be achieved by a combination of physical pressure and/or solvent extraction. The resulting oil is called crude oil. The crude oil may be degummed by hydrating phospholipids and other polar and neutral lipid complexes that facilitate their separation from the nonhydrating, triglyceride fraction (soybean oil). The resulting lecithin gums may be further processed to make commercially important lecithin products used in a variety of food and industrial products as emulsification and release (i.e., antisticking) agents. Degummed oil may be further refined for the removal of impurities (primarily free fatty acids, pigments and residual gums). Refining is accomplished by the addition of a caustic agent that reacts with free fatty acid to form soap and hydrates phosphatides and proteins in the crude oil. Water is used to wash out traces of soap formed during refining. The soapstock byproduct may be used directly in animal feeds or acidulated to recover the free fatty acids. Color is removed through adsorption with a bleaching earth that removes most of the chlorophyll and carotenoid compounds. The refined oil can be hydrogenated, thereby resulting in fats with various melting properties and textures. Winterization (fractionation) may be used to remove stearine from the hydrogenated oil through crystallization under carefully controlled cooling conditions. Deodorization (principally via steam distillation under vacuum) is the last step and is designed to remove compounds which impart odor or flavor to the oil. Other valuable byproducts such as tocopherols and sterols may be removed during the deodorization process. Deodorized distillate containing these byproducts may be sold for production of natural vitamin E and other high-value pharmaceutical products. Refined, bleached, (hydrogenated, fractionated) and deodorized oils and fats may be packaged and sold directly or further processed into more specialized products. A more detailed reference to soybean seed processing, soybean oil production, and byproduct utilization can be found in Erickson, Practical Handbook of Soybean Processing and Utilization, The American Oil Chemists' Society and United Soybean Board (1995). Soybean oil is liquid at room temperature because it is relatively low in saturated fatty acids when compared with oils such as coconut, palm, palm kernel, and cocoa butter.

Plant and microbial oils containing PUFAs that have been refined and/or purified can be hydrogenated, thereby resulting in fats with various melting properties and textures. Many processed fats (including spreads, confectionary fats, hard butters, margarines, baking shortenings, etc.) require varying degrees of solidity at room temperature and can only be produced through alteration of the source oil's physical properties. This is most commonly achieved through catalytic hydrogenation.

Hydrogenation is a chemical reaction in which hydrogen is added to the unsaturated fatty acid double bonds with the aid of a catalyst such as nickel. For example, high oleic soybean oil contains unsaturated oleic, linoleic, and linolenic fatty acids, and each of these can be hydrogenated. Hydrogenation has two primary effects. First, the oxidative stability of the oil is increased as a result of the reduction of the unsaturated fatty acid content. Second, the physical properties of the oil are changed because the fatty acid modifications increase the melting point resulting in a semi-liquid or solid fat at room temperature.

There are many variables which affect the hydrogenation reaction, which in turn alter the composition of the final product. Operating conditions including pressure, temperature, catalyst type and concentration, agitation, and reactor design are among the more important parameters that can be controlled. Selective hydrogenation conditions can be used to hydrogenate the more unsaturated fatty acids in preference to the less unsaturated ones. Very light or brush hydrogenation is often employed to increase stability of liquid oils. Further hydrogenation converts a liquid oil to a physically solid fat. The degree of hydrogenation depends on the desired performance and melting characteristics designed for the particular end product. Liquid shortenings (used in the manufacture of baking products, solid fats and shortenings used for commercial frying and roasting operations) and base stocks for margarine manufacture are among the myriad of possible oil and fat products achieved through hydrogenation. A more detailed description of hydrogenation and hydrogenated products can be found in Patterson, H. B. W., Hydrogenation of Fats and Oils: Theory and Practice. The American Oil Chemists' Society (1994).

Hydrogenated oils have become somewhat controversial due to the presence of trans-fatty acid isomers that result from the hydrogenation process. Ingestion of large amounts of trans-isomers has been linked with detrimental health effects including increased ratios of low density to high density lipoproteins in the blood plasma and increased risk of coronary heart disease.

In yet another aspect the present invention concerns an isolated polynucleotide comprising:
  (a) a nucleotide sequence encoding a polypeptide having diacylglycerol acyltransferase activity wherein the polypeptide is set forth in SEQ ID NOs:83, 88, or 93;
  (b) a complement of the nucleotide sequence of (a), wherein the complement and the nucleotide sequence consist of the same number of nucleotides and are 100% complementary.

And further, a recombinant DNA construct comprising the isolated nucleic acid fragment operably linked to at least one regulatory sequence. As well as a cell comprising in its genome the recombinant DNA construct.

The cell can be part of an oilseed plant, such as, but not limited to, soybean, corn, canola, sunflower, flax, cotton, and safflower.

Finally, the present invention concerns a method for increasing the total fatty acid content of an oilseed comprising:
  (a) transforming at least one oilseed cell with the above mentioned recombinant construct;

(b) selecting the transformed oilseed cell(s) of step (a) having an increased total fatty acid content when compared to the total fatty acid content of a non-transgenic, null segregant oilseed.

EXAMPLES

The present invention is further defined in the following Examples, in which parts and percentages are by weight and degrees are Celsius, unless otherwise stated. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions. Thus, various modifications of the invention in addition to those shown and described herein will be apparent to those skilled in the art from the foregoing description. Such modifications are also intended to fall within the scope of the appended claims.

The meaning of abbreviations is as follows: "sec" means second(s), "min" means minute(s), "h" means hour(s), "d" means day(s), "µL" means microliter(s), "mL" means milliliter(s), "L" means liter(s), "µM" means micromolar, "mM" means millimolar, "M" means molar, "mmol" means millimole(s), "µmole" mean micromole(s), "g" means gram(s), "µg" means microgram(s), "ng" means nanogram(s), "U" means unit(s), "bp" means base pair(s) and "kB" means kilobase(s).

Example 1

Expression of *Yarrowia lipolytica* DGAT Genes in *Saccharomyces cerevisiae*

The DGAT1 gene (SEQ ID NO:1) of *Yarrowia lipolytica* was excised from plasmid vector pYDA1 (SEQ ID NO:2) by restriction digestion with NcoI and NotI. The ends of DNA fragment were completely filled in using T4 DNA polymerase (Promega, Madison, Wis., USA) and ligated into the unique Not I site of pY75 (SEQ ID NO:3). Prior to its use for cloning the pY75 vector had been linearized with NotI, filled in with T4 DNA polymerase and dephosphorylated with shrimp alkaline phosphatase (NEB, Beverly, Mass., USA). Plasmid DNA was isolated using standard techniques and restriction digests with EcoRI were conducted to identify plasmid clones in which the start codon was in proximity to the 3' end of the GPD promoter in pY75 (sense orientation of the DGAT1 gene). This plasmid is henceforth referred to as pY75 YL DGAT1 (SEQ ID NO:4). The construction of pYDA1 is described in PCT Publication No. WO 2006/052914, which is hereby incorporated as reference.

The yeast episomal plasmid (YEp)-type vector pRS425 (SEQ ID NO:5) (Christianson et al., *Gene* 110:119-122 (1992)) contains sequences from the *Saccharomyces cerevisiae* 2 micron endogenous plasmid, a LEU2 selectable marker and sequences based on the backbone of a multifunctional phagemid, pBluescript II SK(+). The *Saccharomyces cerevisiae* strong, constitutive glyceraldehyde-3-phosphate dehydrogenase (GPD) promoter was cloned between the SacII and SpeI sites of pRS425 in the same way as described by Jia et al. (*Physiol. Genomics* 3:83-92 (2000)) to produce pGPD-425 (SEQ ID NO:6). A NotI site was introduced into the BamHI site of pGPD-425, thus giving a NotI site flanked by BamHI sites, and this plasmid was called pY75 (SEQ ID NO:3)

The DGAT2 gene was PCR amplified from the genome of *Yarrowia lipolytica* (ATCC Accession No. 20362) as follows. Yeast cells were grown on solid YPD medium for 72 h. Cells were resuspended in 200 µL of DNA extraction buffer (100 mM Tris pH 7.5, 10 mM EDTA, 100 mM NaCl, 0.1% Triton X-100) and supplemented with 2-5 glass beads (3 mm diameter) and approximately 0.1 g of glass beads (0.5 mm diameter). The yeast cell suspension was mixed vigorously using a vortex mixer and incubated at 75° C. for 25 min. The lysate was cooled to room temperature and cleared by centrifugation.

The following two oligonucleotide primers were used to generate a PCR fragment of approximately 1600 bp:

```
                                        (SEQ ID NO: 7)
oYLDGAT2-1:  GCGGCCGCATGACTATCGACTCACAATACTACAAGT,
and (SEQ ID NO: 8)
oYLDGAT2-2:  GCGGCCGCTTACTCAATCATTCGGAACTCTGGGGCT.
```

Briefly, a PCR reaction mixture (100 µL) containing 2.5 mM $MgCl_2$, 2 mM dNTPs, 10 mM Tris/HCl (pH 8.8), 50 mM KCl, 0.08% Nonidet P40, 1 µM of oYLDGAT2-1 (SEQ ID NO:7) and oYLDGAT2-2 (SEQ ID NO:8), 10 U Taq polymerase (Fermentas, Hanover, Md.), and 2 µL of yeast lysate was created. The PCR mixture was divided into four 25 µL aliquots and amplification was carried out for 35 cycles, each comprising 45 sec at 94° C., 45 sec at the respective annealing temperature, and 1 min at 72° C. PCR products were gel-purified and cloned into pGEM T-easy (Promega) using manufacturer instructions.

Ten independent plasmid clones were completely sequenced. The consensus sequence of this analysis is set forth as SEQ ID NO:9. This DNA sequence differs from the DGAT2 sequence disclosed in PCT Publication No. WO 2005/003322 at two different nucleotide positions. The difference in DNA sequence affects nt 448 and nt 672 of the DGAT2 open reading frame. The former nt difference changes the predicted amino acid sequence of the DGAT protein. It replaces a serine found in the DGAT sequence disclosed in PCT Publication No. WO 2005/003322 with a threonine residue. The second sequence difference does not change the amino acid sequence from the one disclosed in PCT Publication No. WO 2005/003322. The difference between the *Yarrowia lipolytica* DGAT2 sequence disclosed herein and that of PCT Publication No. WO 2005/003322 can be attributed to the different *Yarrowia lipolytica* strains that were used for DGAT2 gene isolation. The predicted amino acid sequence of the DGAT protein of strain ATCC Accession No. 20362 is set forth as SEQ ID NO:10.

The DGAT gene (SEQ ID NO:9) was excised as a Not I restriction fragment from the pGEM T-easy vector and ligated to Not I linearized, dephosphorylated DNA of pY75 (SEQ ID NO:3). Plasmid DNA was isolated form recombinant clones and restriction digestion with SacI and PacI allowed to identify clones in which the start codon of the DGAT2 gene was in proximity to the 3' end of the GPD promoter in pY75 (sense orientation of the DGAT2 gene). This plasmid is henceforth referred to as pY75 YL DGAT2 (SEQ ID NO:11).

Plasmid DNA of pY75 YL DGAT1 (SEQ ID NO:4) and the empty pY75 vector were transformed into the *Saccharomyces cerevisiae* stain INVSC1 (Invitrogen, USA) using standard methods (Gietz, R. Daniel; Woods, Robin A., *Meth. Enzymol.* 350:87-96 (2002)). Recombinant yeast colonies were selected on DOBA media supplemented with CSM-leu (Qbiogene, Carlsbad, Calif.). Five 50 mL cultures of DOBA media supplemented with CSM-leu were inoculated with five independently generated colonies and grown and 30° C. for 72 h. Cells were harvested by centrifugation and resuspended in medium identical to the DOBA medium described above with the exception that ammonium sulfate as nitrogen source was omitted. Cultures were grown for additional 60 h, cells were harvested by centrifugation. Cells were frozen on dry ice and lyophilized.

Total fatty acid content of each yeast cell sample was measured in triplicates as follows. Approximately 5-15 mg of yeast powder were weighed into the bottom of a 13×100 mm glass culture tube with screw cap and Teflon seal. 5 μL of a stock solution of 17:0 TAG (10 mg/mL in toluene) was added followed by addition of 500 μL 5% sulfuric acid in methanol (anhydrous). Samples were incubated at 95° C. for 1.5 h. Subsequently, tubes were allowed to cool to room temperature after which 1 mL of 1 M sodium chloride was added followed by mixing. 1 mL of heptane was added, contents were mixed and samples were spun briefly to mediate phase separation. Approximately 500 μL of the organic phase was transferred to a GC vial. Fatty acid methyl esters were analyzed by gas chromatography. 4 μL of heptane extract were analyzed on Hewlett-Packard 6890 Gas Chromatograph fitted with an Omegawax 320 fused silica capillary column (Supelco Inc., Catalog No. 24152). The oven temperature was programmed to hold at 220° C. for 2.7 min, increase to 240° C. at 20 C./min and then hold for an additional 2.3 min. Carrier gas was supplied by a Whatman hydrogen generator. Retention times were compared to those for methyl esters of standards commercially available (Nu-Chek Prep, Inc. catalog #U-99-A).

Plasmid DNA of pY75 YL DGAT2 (SEQ ID NO:11) and the empty pY75 vector were transformed into the *Saccharomyces cerevisiae* strain INVSC1 and total fatty acid content of recombinant yeast cultures was analyzed as described previously. The findings related to over expression of both DGAT genes in yeast are summarized in TABLE 2.

TABLE 2 shows that there is a significant increase of total fatty acids in yeast cells harboring the pY75 YL DGAT1 (SEQ ID NO:4) compared to cells that only contain the empty pY75 plasmid. The average fatty acid dry cell weight (DCW) percentage of five independent cultures is 11.9% compared to 9.3% for vector controls grown under identical conditions. In summary, there is a 28% increase in total fatty acid production. Moreover, there is a slight alteration in the fatty acid profile associated with YL DGAT1 expression characterized by an increase in palmitic acid.

Constitutive expression of YL DGAT2 under nitrogen starvation increased total fatty acid content by 110% compared to a vector control grown under identical conditions. Total fatty acid content of the vector only control was 6.6% whereas the average fatty acid content of the YL DGAT2 transformants was 14.2%. The fatty acid profile changed as result of YL DGAT2 expression. Palmitic acid content increased significantly accompanied by a moderate decrease in palmitoleic. In addition, stearic acid content increased significantly accompanied by a clear decrease in oleic content. Taken together the results show that YL DGATs over-expression in yeast under conditions of increased carbon/nitrogen ratios lead to increased fatty acid accumulation. The overexpressed YL DGAT enzymes are able to augment endogenous DGAT activity in *Saccharomyces cerevisiae*. Similar experiments were repeated with both DGAT genes two more times. A difference in fatty acid content between YL DGAT culture and vector control could be observed every time and was at least 8% and 14.3% for YL DGAT1 (SEQ ID NO:1) and YL DGAT2 (SEQ ID NO:9), respectively.

Example 2

Cloning the *Yarrowia lipolytica* DGAT1 and DGAT2 into *Yarrowia lipolytica* Expression Vectors The present Example describes the generation of pFBAIN-YDG1 and pFBAIN-YDG2, comprising a chimeric FBAINm::YDGAT1::PEX20 gene and a chimeric FBAINm::YDGAT2::PEX20 gene, respectively (FIGS. 1A and 1B).

TABLE 2

Total Fatty Acid Content of Saccharomyces cerevisea Cultures

|   | % palmitic acid | % palmitoleic acid | % stearic acid | % oleic acid | FAME (% DCW) | stdv | average FAME (% DCW) | stdv FAME (% DCW) |
|---|---|---|---|---|---|---|---|---|
| pY75 YL DGAT1 | 19.1 | 38.4 | 7.5 | 34.9 | 12.8 | 2.2 | | |
|  | 19.4 | 38.8 | 7.4 | 34.3 | 12.3 | 0.4 | | |
|  | 19.2 | 38.4 | 7.6 | 34.8 | 12.2 | 0.4 | | |
|  | 19.3 | 38.6 | 7.5 | 34.6 | 11.5 | 0.1 | | |
|  | 19.1 | 38.3 | 7.7 | 34.9 | 10.9 | 0.6 | 11.9 | 0.8 |
| pY75 | 17.9 | 37.8 | 7.9 | 36.4 | 10.7 | 1.0 | | |
|  | 18.2 | 38.2 | 7.8 | 35.8 | 9.7 | 0.6 | | |
|  | 17.9 | 41.0 | 6.8 | 34.2 | 8.7 | 0.3 | | |
|  | 17.2 | 40.5 | 6.9 | 35.4 | 8.7 | 0.6 | | |
|  | 18.1 | 41.1 | 6.9 | 33.9 | 8.5 | 0.2 | 9.3 | 0.9 |
| pY75 YL DGAT2 | 31.8 | 34.0 | 14.2 | 20.0 | 17.1 | 0.2 | | |
|  | 31.4 | 33.1 | 14.8 | 20.6 | 15.9 | 0.6 | | |
|  | 30.7 | 32.8 | 14.7 | 21.8 | 13.6 | 1.1 | | |
|  | 28.9 | 34.2 | 13.5 | 23.5 | 12.4 | 1.4 | | |
|  | 29.2 | 34.1 | 13.5 | 23.1 | 11.8 | 1.7 | 14.2 | 2.3 |
| pY75 | 19.7 | 37.0 | 9.6 | 33.7 | 7.0 | 0.4 | | |
|  | 20.0 | 36.4 | 9.8 | 33.7 | 6.8 | 0.0 | | |
|  | 19.6 | 37.0 | 9.6 | 33.8 | 6.6 | 0.6 | | |
|  | 19.7 | 37.1 | 9.5 | 33.6 | 6.4 | 0.2 | | |
|  | 19.3 | 36.9 | 9.7 | 34.1 | 6.4 | 0.3 | 6.6 | 0.2 |

These were designed for overexpression of the DGAT1 and DGAT2 in *Yarrowia lipolytica*.

Oligonucleotides YDGAT1-F (SEQ ID NO:12) and YDGAT-R (SEQ ID NO:13) were designed and synthesized to allow amplification of the DGAT1 ORF from *Yarrowia lipolytica* genomic DNA (isolated from strain ATCC Accession No. 20362, purchased from the American Type Culture Collection (Rockville, Md.)), while oligonucleotides YDGAT2-F (SEQ ID NO:14) and YDGAT2-R (SEQ ID NO:15) were designed and synthesized to allow the amplification of the DGAT2 ORF.

The PCR reactions, with *Yarrowia lipolytica* genomic DNA as template, were individually carried out in a 50 μL total volume comprising: 1 μL each of 20 μM forward and reverse primers, 1 μL genomic DNA (100 ng), 10 μL 5×PCR buffer, 1 μL dNTP mix (10 μM each), 35 μL water and 1 μL Phusion polymerase (New England Biolabs, Inc., Ipswich, Mass.). Amplification was carried out at 98° C. for 1 min, followed by 30 cycles at 98° C. for 10 sec, 55° C. for 10 sec, and 72° C. for 30 sec, followed by a final elongation cycle at 72° C. for 5 min. A 1603 bp DNA fragment (SEQ ID NO:16) and a 1567 bp fragment (SEQ ID NO:17) were generated that contained the DGAT1 and DGAT2 ORFs, respectively.

The PCR fragments were purified with Qiagen PCR purification kits following the manufacturer's protocol. Purified DNA samples were digested with NcoI and NotI, purified with a Qiagen reaction clean-up kit, and then directionally ligated with NcoI/NotI digested pFBAIN-MOD-1 (FIG. 1C; SEQ ID NO:18). Specifically, the ligation reaction contained: 10 μL 2× ligation buffer, 1 μL T4 DNA ligase (Promega), 4 μL (~300 ng) of either the 1600 bp fragment (i.e., DGAT1; SEQ ID NO:16) or the 1564 bp fragment (i.e., DGAT2; SEQ ID NO:17) and 1 μL PFBAIN-MOD-1 (~150 ng). The reaction mixtures were incubated at room temperature for 2 h and used to transform *E. coli* Top10 competent cells (Invitrogen). Plasmid DNA from transformants was recovered using a Qiagen Miniprep kit. Correct clones were identified by restriction mapping and the final constructs were designated "pFBAIN-YDG1" and "pFBAIN-YDG2", respectively.

Thus, pFBAIN-YDG1 (FIG. 1A; SEQ ID NO:19) thereby contained the following components:

TABLE 3

Components of Plasmid pFBAIN-YDG1 (SEQ ID NO: 19)

| RE Sites And Nucleotides Within SEQ ID NO: 19 | Description of Fragment and Chimeric Gene Components |
|---|---|
| BglII-BsiWI (6040-301) | FBAINm::YDG1::PEX20, comprising:<br>FBAINm: *Yarrowia lipolytica* FBAINm promoter (PCT Publication No. WO 2005/049805)<br>YDG1: *Y. lipolytica* DGAT1 ORF (SEQ ID NO: 16)<br>Pex20: Pex20 terminator sequence of *Yarrowia* Pex20 gene (GenBank Accession No. AF054613) |
| PacI-BglII (4533-6040) | *Yarrowia* URA3 (GenBank Accession No. AJ306421) |
| (3123-4487) | *Yarrowia* autonomous replicating sequence 18 (ARS18; GenBank Accession No. M91600 and No. A17608) |
| (2464-2864) | f1 origin |
| (1424-2284) | ampicillin-resistance gene (Amp$^R$) for selection in *E. coli* |
| (474-1354) | ColE1 plasmid origin of replication |

Plasmid pFBAIN-YDG2 (FIG. 1B; SEQ ID NO:20) contained components identical to those of pFBAIN-YDG1, with the exception that the *Yarrowia lipolytica* DGAT2 ORF (SEQ ID NO:17; identified as YDG2 on FIG. 1B) was present instead of the *Yarrowia lipolytica* DGAT1 ORF in pFBAIN-YDG1.

The term "FBAINm promoter" or "FBAINm promoter region" is a modified version of the FBAIN promoter (infra), wherein FBAINm has a 52 bp deletion between the ATG translation initiation codon and the intron of the FBAIN promoter (thereby including only 22 amino acids of the N-terminus) and a new translation consensus motif after the intron. Furthermore, while the FBAIN promoter generates a fusion protein when fused with the coding region of a gene to be expressed, the FBAINm promoter does not generate such a fusion protein. The FBAIN promoter refers to the 5' upstream untranslated region in front of the 'ATG' translation initiation codon of the *Yarrowia lipolytica* fructose-bisphosphate aldolase enzyme (E.C. 4.1.2.13) encoded by the fba1 gene and that is necessary for expression, plus a portion of 5' coding region that has an intron of the fba1 gene. These promoters are described in detail in PCT Publication No. WO 2005/049805 and U.S. Pat. No. 7,202,356, which are hereby incorporated by reference in their entirety.

Example 3

Overexpression of *Yarrowia lypolytica* DGAT1 and DGAT2 Genes in *Yarrowia lipolytica* Strain Y2224

The present Example describes increased fatty acid content, and modification to the relative abundance of each fatty acid species, in *Yarrowia lipolytica* strain Y2224 that was transformed to co-express either the *Yarrowia lipolytica* DGAT1 (SEQ ID NO:16) or the *Yarrowia lipolytica* DGAT2 (SEQ ID NO:17). Strain Y2224 is a FOA resistant mutant from an autonomous mutation of the Ura3 gene of wild type *Yarrowia* strain ATCC Accession No. 20362.

Generation Of Strain Y2224: Strain Y2224 was isolated in the following manner: *Yarrowia lipolytica* ATCC Accession No. 20362 cells from a YPD agar plate (1% yeast extract, 2% bactopeptone, 2% glucose, 2% agar) were streaked onto a minimal media plate (75 mg/L each of uracil and uridine, 6.7 g/L YNB with ammonia sulfate, without amino acid, and 20 g/L glucose) containing 250 mg/L 5-FOA (5-fluorouracil-6-carboxylic acid monohydrate; Zymo Research). Plates were incubated at 28° C. and four of the resulting colonies were patched separately onto minimal media (MM) plates containing 200 mg/mL 5-FOA and MM plates lacking uracil and uridine to confirm uracil Ura3 auxotrophy.

Transformation of Strain Y2224: A clone of pFBAIn-YDG1, a clone of pFBAIn-YDG2 and control plasmid pFBAIN-MOD-1 were transformed into *Yarrowia lipolytica* strain Y2224 as described below.

Transformation of *Yarrowia lipolytica* was performed according to the method of Chen, D. C. et al. (*Appl. Microbiol Biotechnol*. 48(2):232-235 (1997)), unless otherwise noted. Briefly, *Yarrowia* was streaked onto a YPD agar plate and grown at 30° C. for approximately 18 h. Several large loopfuls of cells were scraped from the plate and resuspended in 1 mL of transformation buffer containing: 2.25 mL of 50% PEG, average MW 3350; 0.125 mL of 2 M lithium acetate, pH 6.0; 0.125 mL of 2 M DTT; and 50 μg sheared salmon sperm DNA. Then, approximately 500 ng of linearized plasmid DNA was incubated in 100 μL of resuspended cells, and maintained at 39° C. for 1 h with vortex mixing at 15 min intervals.

The cells from each transformation were plated onto minimal media (MM) plates lacking uracil (0.17% yeast nitrogen base (DIFCO Laboratories, Detroit, Mich.) without ammonium sulfate or amino acids, 2% glucose, 0.1% proline, pH 6.1, 20 g/L agar) and maintained at 30° C. for 2 days. Three transformants from each transformation plate were used to inoculate individual 25 mL culture in MM medium (0.17% yeast nitrogen base (DIFCO Laboratories) without ammonium sulfate or amino acids, 2% glucose, 0.1% proline, pH 6.1). Each culture was allowed to grow for 2 days at 30° C., then switched into 25 mL of high glucose medium ("HG medium", comprising 80 g/L glucose, 27 g/L $K_2HPO_4$, 6.3 g/L $KH_2PO_4$, pH ~7.5) and allowed to grow for 5 days at 30° C.

Lipid Analysis: Total lipids were extracted, and fatty acid methyl esters (FAMEs) were prepared by trans-esterification, and subsequently analyzed with a Hewlett-Packard 6890 GC.

More specifically, for fatty acid analysis, cells were collected by centrifugation and lipids were extracted as described in Bligh, E. G. & Dyer, W. J. (*Can. J. Biochem. Physiol.* 37:911-917 (1959)). Fatty acid methyl esters were prepared by transesterification of the lipid extract with sodium methoxide (Roughan, G. and Nishida I., *Arch Biochem Biophys.* 276(1):38-46 (1990)) and subsequently analyzed with a Hewlett-Packard 6890 GC fitted with a 30-m× 0.25 mm (i.d.) HP-INNOWAX (Hewlett-Packard) column. The oven temperature was from 170° C. (25 min hold) to 185° C. at 3.5° C./min.

For direct base transesterification, *Yarrowia* culture (3 mL) was harvested, washed once in distilled water, and dried under vacuum in a Speed-Vac for 5-10 min. Sodium methoxide (100 µL of 1%) was added to the sample, and then the sample was vortexed and rocked for 20 min. After adding 3 drops of 1 M NaCl and 400 µL hexane, the sample was vortexed and spun. The upper layer was removed and analyzed by GC as described above.

Based on the above analyses, lipid content and composition was determined in transformant strains of Y2224, comprising pFBAIn-YDG1, pFBAIn-YDG2 and pFBAIN-MOD-1 (control), respectively, as shown below in TABLE 4. Three independent transformants of each strain were analyzed, while the average results are shown in the rows highlighted in grey. Fatty acids are identified as 16:0 (palmitate), 16:1 (palmitoleic acid), 18:0, 18:1 (oleic acid) and 18:2 (LA); and the composition of each is presented as a % of the total fatty acids.

"% FAME/DCW" represents the percent fatty acid methyl ester/dry cell weight. Dry cell weight was determined by collecting cells from 10 mL of culture via centrifugation, washing the cells with water once to remove residue medium, drying the cells in a vacuum oven at 80° C. overnight, and weighing the dried cells. The total amount of fatty acid methyl esters in a sample was determined by comparing the areas of all peaks in the GC profile with the peak area of an added known amount of internal standard C15:0 fatty acid.

TABLE 4

Lipid Content A\ and Composition in *Yarrowia* Strain Y2224 Overexpressing YDGAT1 And YDGAT2

| Sample | Plasmid | % FAME/DCW | 16:0 | 16:1 | 18:0 | 18:1 | 18:2 |
|---|---|---|---|---|---|---|---|
| 1 | pFBAIn-MOD-1 | 21.91 | 15.96 | 16.41 | 6.01 | 40.28 | 18.36 |
| 2 | pFBAIn-MOD-1 | 23.98 | 16.72 | 15.90 | 5.97 | 39.64 | 18.21 |
| 3 | pFBAIn-MOD-1 | 18.27 | 14.42 | 15.74 | 5.59 | 41.07 | 19.89 |
| Avg. 1-3 | Avg. pFBAIn-MOD-1 | 21.39 | 15.70 | 16.02 | 5.86 | 40.33 | 18.82 |
| 4 | pFBAIn-YDG1 | 22.50 | 15.76 | 16.74 | 5.95 | 40.72 | 17.79 |
| 5 | pFBAIn-YDG1 | 24.38 | 14.76 | 18.86 | 4.60 | 43.90 | 15.89 |
| 6 | pFBAIn-YDG1 | 24.22 | 15.20 | 18.42 | 4.66 | 43.20 | 16.1 |
| Avg. 4-6 | Avg. pFBAIn-YDG1 | 23.70 | 15.24 | 18.01 | 5.07 | 42.61 | 16.59 |
| 7 | pFBAIn-YDG2 | 23.51 | 13.56 | 13.55 | 7.70 | 46.20 | 16.45 |
| 8 | pFBAIn-YDG2 | 29.30 | 15.10 | 12.87 | 8.00 | 45.49 | 15.24 |
| 9 | pFBAIn-YDG2 | 29.15 | 14.57 | 13.74 | 8.44 | 47.00 | 13.79 |
| Avg. 7-9 | Avg. pFBAIn-YDG2 | 27.32 | 14.41 | 13.38 | 8.05 | 46.23 | 15.16 |

GC analyses showed that there was a significant increase of total fatty acids in cells carrying pFBAIn-YDG1, as compared to cells carrying pFBAIn-MOD-1. The average fatty acid increased from 21.39% FAME/DCW in the control to 23.70% FAME/DCW in cells expressing YDGAT1 (i.e., a 10.8% increase). Furthermore, there was also an increase in the amount of C16:1 and C18:1 fatty acids and a decrease of C18:2 fatty acid (TABLE 4).

Cells carrying pFBAIn-YDG2 also had a large increase in total fatty acid content relative to the control, resulting in an average of 27.32% FAME/DCW (representing an increase of 27.7%). The distribution of fatty acid species also changed significantly. Specifically, the amount of C18:0 and C18:1 was increased, whereas the amount of C16:0, C16:1 and C18:2 decreased.

Collectively, these results demonstrate that overexpression of the *Yarrowia lipolytica* DGAT1 or DGAT2 impacts both total lipid content and the relative abundance of each fatty acid species.

Example 4

Expression of *Yarrowia lipolytica* DGAT Genes in *Arabidopsis* Seed

A binary vector suitable for agrobacterium-mediated transformation was generated as follows. Various restriction sites were added, through a number of cloning steps, to the ends of the Bcon/NotI/Phas3' cassette from KS123 (SEQ ID NO:21), which was previously described in PCT Publication No. WO 02/008269 (the contents of which are hereby incorporated by reference). Briefly, a DNA fragment (cal a24-4; SEQ ID NO:22) was amplified from plasmid CalFad2-2 (described in PCT Publication No. WO 01/12800) using primers oCal-15 (SEQ ID NO:23) and oCal-6 (SEQ ID NO:24). DNA fragment cal a24-4 (SEQ ID NO:22) was digested with Bg/II and BamHI and cloned into the BamHI site of pKS123 to give pKR53B (SEQ ID NO:25). The XbaI/SbfI fragment of pKR53B, containing the Bcon/NotI/Phas3' cassette was cloned into the XbaI/SbfI fragment of pKR72 (ATCC Accession No. PTA-6019; SEQ ID NO:26) containing the bacterial hygromycin phosphotransferase gene, to give pKR85 (SEQ ID NO:27). The features of pKR72 are as follows. A starting plasmid pKR72 (ATCC Accession No. PTA-6019; SEQ ID NO:26), a derivative of pKS123 which was previously described in PCT Publication No. WO 02/008269 (the contents of which are hereby incorporated by reference), contains the hygromycin B phosphotransferase gene (HPT) (Gritz, L.

and Davies, J., *Gene* 25:179-188 (1983)), flanked by the T7 promoter and transcription terminator (T7prom/hpt/T7term cassette), and a bacterial origin of replication (ori) for selection and replication in bacteria (e.g., *E. coli*). In addition, pKR72 also contains the hygromycin B phosphotransferase gene, flanked by the 35S promoter (Odell et al., *Nature* 313: 810-812 (1985)) and NOS 3' transcription terminator (Depicker et al., *J. Mol. Appl. Genet.* 1:561-570 (1982)) (35S/hpt/NOS3' cassette) for selection in plants such as soybean. pKR72 also contains a NotI restriction site, flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)), thus allowing for strong tissue-specific expression in the seeds of soybean of genes cloned into the NotI site.

The Bcon/NotI/Phas3' cassette was amplified from plasmid pKR85 (SEQ ID NO:27) using primers oKR85-1 (SEQ ID NO:28) and oKR85-2 (SEQ ID NO:29) and the resulting DNA fragment was cloned into PCR-Script® (Stratgene) following the manufacture's protocol, to give pPCR85 (SEQ ID NO:30).

The EcoRI/BglII fragment of pPCR85, containing the Bcon/NotI/Phas3' cassette was cloned into the EcoRI/BamHI fragment of plasmid pZS199 (PCT Publication No. WO 93/11245; also U.S. Pat. No. 5,952,544 which was published on Jun. 10, 1993; the disclosures of which are hereby incorporated by reference), containing the *Arabidopsis* binary vector backbone to produce pKR91 (SEQ ID NO:31).

The Bcon/NotI/Phas3' cassette was removed from pKR91 by digestion with AscI and the re-ligated binary vector containing a unique AscI cloning site was produced called pKR92 (SEQ ID NO:32).

Construction of pKR92 YL DGAT2:

The construction of expression plasmid KS362 is described in Example 5. An expression cassette which harbors the YL DGAT2 gene, fused to betaconglycinin promoter and the phaseolin terminator and DsRed gene fused to Kti promoter and terminator sequences was excised from KS362 as a 6.4 kb AscI fragment. This DNA was ligated to AscI linearized, dephosphorylated pKR92 vector DNA to give pKR92 YL DGAT2 (SEQ ID NO:33).

Construction of pKR92 YL DGAT1/YL DGAT2:

The construction of expression plasmid KS364 is described in Example 5. An expression cassette in which YL DGAT1 (SEQ ID NO:1) and YL DGAT2 (SEQ ID NO:9) genes are fused to identical sequence of the phaseolin terminator and to glycinin 1 and betaconglycinin promoters respectively was excised from KS364 as a 7 kb AscI fragment. This DNA was ligated to AscI linearized, dephosphorylated pKR92 vector DNA to give pKR92 YL DGAT1/YL DGAT2 (SEQ ID NO:34)

Generation and Analysis of Transgenic *Arabidopsis* Lines:

Plasmid DNA of pKR92 YL DGAT2 and pKR92 YL DGAT1/YL DGAT2 was introduced into *Agrobacterium tumefaciens* NTL4 (Luo et al, *Molecular Plant-Microbe Interactions* 14(1):98-103 (2001)) by electroporation. Briefly, 1 µg plasmid DNA was mixed with 100 µL of electrocompetent cells on ice. The cell suspension was transferred to a 100 µL electro oration curette (1 mm gap width) and electro orated using a BIORAD electro orator set to 1 kV, 400Ω and 25 µF. Cells were transferred to 1 mL LB medium and incubated for 2 h at 30° C. Cells were plated onto LB medium containing 50 µg/mL kanamycin. Plates were incubated at 30° C. for 60 h. Recombinant *agrobacterium* cultures (500 mL LB, 50 µg/mL kanamycin) were inoculated from single colonies of transformed *agrobacterium* cells and grown at 30° C. for 60 h. Cells were harvested by centrifugation (5000×g, 10 min) and resuspended in 1 L of 5% (W/V) sucrose containing 0.05% (VN) Silwet. *Arabidopsis* plants were grown in soil at a density of 30 plants per 100 $cm^2$ pot in metromix 360 soil mixture for 4 weeks (22° C., permanent light, 100 µE $m^{-2}s^{-1}$). Plants were repeatedly dipped into the *agrobacterium* suspension harboring the binary vectors and kept in a dark, high humidity environment for 24 h. Plants were grown for four to five weeks under standard plant growth conditions described above and plant material was harvested and dried for one week at ambient temperatures in paper bags. Seeds were harvested using a 0.425 mm mesh brass sieve.

Cleaned *Arabidopsis* seeds (2 g, corresponding to about 100,000 seeds) were sterilized by washes in 45 mL of 80% ethanol, 0.01% triton X-100, followed by 45 mL of 30% (V/V) household bleach in water, 0.01% triton X-100 and finally by repeated rinsing in sterile water. Aliquots of 20,000 seeds were transferred to square plates (20×20 cm) containing 150 mL of sterile plant growth medium comprised of 0.5×MS salts, 1.0% (W/V) sucrose, 0.05 MES/KOH (pH 5.8), 200 µg/mL timentin, and 50 µg/mL kanamycin solidified with 10 g/L agar. Homogeneous dispersion of the seed on the medium was facilitated by mixing the aqueous seed suspension with an equal volume of melted plant growth medium. Plates were incubated under standard growth conditions for ten days. Kanamycin-resistant seedlings were transferred to plant growth medium without selective agent and grown to maturity for 8-10 weeks (22° C., permanent light dark, 100-200 µE $m^{-2}s^{-1}$). Plants were grown in flats with 36 inserts. In every flat at least six untransformed wild type control plants were grown next to approximately thirty T2 plants. Seeds were harvested from individual plants and seed oil content was measured by NMR.

NMR Based Analysis of Seed Oil Content:

Seed oil content was determined using a Maran Ultra NMR analyzer (Resonance Instruments Ltd, Whitney, Oxfordshire, UK). Samples (either individual soybean seed or batches of *Arabidopsis* seed ranging in weight between 5 and 200 mg) were placed into pre-weighed 2 mL polypropylene tubes (Corning Inc, Corning N.Y., USA; Part no. 430917) previously labeled with unique bar code identifiers. Samples were then placed into 96 place carriers and processed through the following series of steps by an Adept Cobra 600 SCARA robotic system.

1. pick up tube (the robotic arm was fitted with a vacuum pickup devise)
2. read bar code
3. expose tube to antistatic device (ensured that *Arabidopsis* seed were not adhering to the tube walls)
4. weigh tube (containing the sample), to 0.0001 g precision.
5. NMR reading; measured as the intensity of the proton spin echo 1 msec after a 22.95 MHz signal had been applied to the sample (data was collected for 32 NMR scans per sample)
6. return tube to rack
7. repeat process with next tube Bar codes, tubes weights and NMR readings were recorded by a computer connected to the system. Sample weight was determined by subtracting the polypropylene tube weight from the weight of the tube containing the sample.

Seed oil content of soybeans seed was calculated as follows:

$$\% \text{ oil (\% wt basis)} = \frac{(NMR \text{ signal/sample wt (g)}) - 70.58}{351.45}$$

Calibration parameters were determined by precisely weighing samples of soy oil (ranging from 0.0050 to 0.0700 g at approximately 0.0050 g intervals; weighed to a precision of 0.0001 g) into Corning tubes (see above) and subjecting them to NMR analysis. A calibration curve of oil content (% seed wt basis; assuming a standard seed weight of 0.1500 g) to NMR value was established.

The relationship between seed oil contents measured by NMR and absolute oil contents measured by classical analytical chemistry methods was determined as follows. Fifty soybean seed, chosen to have a range of oil contents, were dried at 40° C. in a forced air oven for 48 h. Individual seeds were subjected to NMR analysis, as described above, and were then ground to a fine powder in a GenoGrinder (SPEX Centriprep (Metuchen, N.J., U.S.A.); 1500 oscillations per minute, for 1 minute). Aliquots of between 70 and 100 mg were weighed (to 0.0001 g precision) into 13×100 mm glass tubes fitted with Teflon® lined screw caps; the remainder of the powder from each bean was used to determine moisture content, by weight difference after 18 h in a forced air oven at 105° C. Heptane (3 mL) was added to the powders in the tubes and after vortex mixing samples were extracted, on an end-over-end agitator, for 1 h at room temperature. The extracts were centrifuged, 1500×g for 10 min, the supernatant decanted into a clean tube and the pellets were extracted two more times (1 h each) with 1 mL heptane. The supernatants from the three extractions were combined and 50 µL internal standard (triheptadecanoic acid; 10 mg/mL toluene) was added prior to evaporation to dryness at room temperature under a stream of nitrogen gas; standards containing 0, 0.0050, 0.0100, 0.0150, 0.0200 and 0.0300 g soybean oil, in 5 mL heptane, were prepared in the same manner. Fats were converted to fatty acid methyl esters (FAMEs) by adding 1 mL 5% sulfuric acid (v:v. in anhydrous methanol) to the dried pellets and heating them at 80° C. for 30 min, with occasional vortex mixing. The samples were allowed to cool to room temperature and 1 mL 25% aqueous sodium chloride was added followed by 0.8 mL heptane. After vortex mixing the phases were allowed to separate and the upper organic phase was transferred to a sample vial and subjected to GC analysis.

Plotting NMR determined oil contents versus GC determined oil contents resulted in a linear relationship between 9.66 and 26.27% oil (GC values; % seed wt basis) with a slope of 1.0225 and an $R^2$ of 0.9744; based on a seed moisture content that averaged 2.6+/−0.8%.

Seed Oil Content of *Arabidopsis* Seed was Calculated as Follows:

mg oil=(NMR signal−2.1112)/37.514

% oil (% wt basis)=(mg oil/1000)/sample weight *100

Prior to establishing this formula, *Arabidopsis* seed oil was extracted as follows. Approximately 5 g of mature *Arabidopsis* seed (cv Columbia) were ground to a fine powder using a mortar and pestle. The powder was placed into a 33×94 mm paper thimble (Ahlstrom #7100-3394; Ahlstrom, Mount Holly Springs, Pa., USA) and the oil extracted during approximately 40 extraction cycles with petroleum ether (BP 39.9-51.7° C.) in a Soxhlet apparatus. The extract was allowed to cool and the crude oil was recovered by removing the solvent under vacuum in a rotary evaporator. Calibration parameters were determined by precisely weighing 11 standard samples of partially purified *Arabidopsis* oil (samples contained 3.6, 6.3, 7.9, 9.6, 12.8, 16.3, 20.3, 28.2, 32.1, 39.9 and 60 mg of partially purified *Arabidopsis* oil) weighed to a precision of 0.0001 g) into 2 mL polypropylene tubes (Corning Inc, Corning N.Y., USA; Part no. 430917) and subjecting them to NMR analysis. A calibration curve of oil content (% seed wt basis) to NMR value was established.

Seed for pKR92 YL DGAT2 T2 were grown from a total of 293 independent events alongside 75 wild type controls. Oil content of YL DGAT2 transgenics ranged from 27.9-47.3%. Average oil content was 43.7%. Oil content of wild type controls ranged from 39.5-49.6%. Average oil content of wt controls was 44.8%.

Seed for pKR92 YL DGAT1/YL DGAT2 T2 were grown from a total of 295 independent events alongside 77 wild type controls. Oil content of YL DGAT1/YL DGAT2 transgenics ranged from 34.5-47.6%. Average oil content was 44%. Oil content of wild type controls ranged from 41.3-46.6%. Average oil content of wild type controls was 45%. In summary, these findings suggest that seed-specific expression of YL DGAT gene does not increase oil content of *arabidopsis* seed.

Analysis of the Fatty Acid Profile of *Arabidopsis* Seed Expressing YL DGAT2 Alone or in Combination with YL DGAT1:

GC analysis of FAME was employed to investigate if YL DGAT expression alters the fatty acid profile of *arabidopsis* seed. Approximately 100 F2 seed were dispensed into individual wells of 96 well strip tubes. For transesterification, 50 µL of trimethylsulfonium hydroxide (TMSH) and 0.5 mL of hexane were added to the each strip tube and incubated for 30 min at room temperature while shaking. Fatty acid methyl esters (1 µL injected from hexane layer) were separated and quantified using a Hewlett-Packard 6890 Gas Chromatograph fitted with an Omegawax 320 fused silica capillary column (Catalog #24152, Supelco Inc.). The oven temperature was programmed to hold at 220° C. for 2.6 min, increase to 240° C. at 20° C./min and then hold for an additional 2.4 min. Carrier gas was supplied by a Whatman hydrogen generator. Retention times were compared to those for methyl esters of standards commercially available (Nu-Chek Prep, Inc.). Results are summarized in TABLE 5.

TABLE 5

|  | avg % oleic | range % oleic |
|---|---|---|
| pKR92 YL DGAT1/YL DGAT2 (n = 28) | 18.7 | 15.2-22.3 |
| wild type control (n = 8) | 15.2 | 14.5-15.6 |
| pKR92 YL DGAT2 (n = 26) | 16.4 | 14.9-18.4 |
| wild type control (n = 7) | 15.7 | 15.6-16 |

Results clearly demonstrate that expression of YL DAGT2 and even more so co-expression of YL DGAT1 and YL DGAT2 in *Arabidopsis* seed leads to increased incorporation of oleic acid into seed lipids which provides the first indication that active YL DGAT1 and YL DGAT2 proteins can be produced in transgenic seed.

Example 5

Expression of *Yarrowia lipolytica* DGAT Genes in Soybean Somatic Embryos

TABLE 6 and TABLE 7 list promoter and terminator sequences that were used in plasmid constructs for seed specific over-expression of YL DGAT genes.

TABLE 6

Seed-specific Promoters

| Promoter | Organism | Promoter Reference |
|---|---|---|
| β-conglycinin α'-subunit | soybean | Beachy et al., EMBO J. 4: 3047-3053 (1985) |
| kunitz trypsin inhibitor | soybean | Jofuku et al., Plant Cell 1: 1079-1093 (1989) |
| glycinin Gy1 | soybean | WO 2004/071467 |
| BD30 (also called P34) | soybean | WO 2004/071467 |

TABLE 7

Transcription Terminators

| Transcription Terminator | Organism | Reference |
|---|---|---|
| phaseolin 3' | bean | WO 2004/071467 |
| kunitz trypsin inhibitor 3' | soybean | WO 2004/071467 |

Construction of a plasmid construct for expression of the YL DGAT1 gene under control of the glycinin Gy1 promoter (KS349) (FIG. 3).

The isolation of soybean glycinin Gy1 promoter was performed as follows. Based on the sequences of the soybean glycinin Gy1 gene sequence (GenBank Accession No. X15121; SEQ ID NO:35) in the NCBI database, two oligos with either BamHI or NcoI sites at the 5' ends were designed to amplify the soybean glycinin Gy1 promoter (SEQ ID NO:36). The oligonucleotide sequences of these two oligos are as follows:

```
SEQ ID NO: 37 (oGy1-1):
CGCGGATCCTAGCCTAAGTACGTACTCAAAATGCCA

SEQ ID NO: 38 (oGy1-2):
GAATTCCCATGGGGTGATGACTGATGAGTGTTTAAGGAC
```

Plasmid pKS349 was constructed in many steps from a number of different intermediate vectors. The amplified soybean glycinin Gy1 promoter fragment was digested with BamHI and NcoI, purified and cloned into the BamHI and NcoI sites of p24K-G4G-@SalI (PCT Application No. WO 98/59062) to give pZBL114 (SEQ ID NO:39). The NcoI/KpnI fragment containing GUS was replaced with an NcoI/KpnI fragment containing a fusion product of the soybean GY1 gene (SEQ ID NO:40) and the synthetic barley high lysine 8 (BHL8) gene (U.S. Pat. No. 6,800,726 B1) (SEQ ID NO:41;) to make pZBL133 (SEQ ID NO:43). The DNA sequence of the fusion product of soy GY1 gene and BHL8 gene is set forth as SEQ ID NO: 42. The phaseolin terminator was removed from pZBL133 (XbaI/filled in) and replaced with the phaseolin terminator found in pKS123 (PCT Application No. WO 02/08269) (blunt) to give pKS238 (SEQ ID NO:44). The GY1-BHL8 fusion was replaced with native GY1 sequence as follows. pKS238 was was digested with KpnI/BglII, the remaining vector band (5.1 kb) was ligated to a DNA fragment (BglI/KpnI) of the native GY1 gene (SEQ ID NO:40) to give pKS240 (SEQ ID NO: 45) The BamHI/SalI fragment containing Gy1/GM-GY1/Phas3' was excised from pKS 240 and ligated to the BamHI/SalI sites of pKS120 (SEQ ID NO:46) to give pKS242 (SEQ ID NO:47). Plasmid pKS120 is identical to pKS123 (supra) with the exception that the HindIII fragment containing Bcon/NotI/Phas3' cassette was removed. The NcoI/NotI fragment containing GM-GY1 was replaced with the NcoI/NotI fragment containing YL-DGAT1 from pYDA1 to give pKS349 (SEQ ID NO:48).

Construction of a Construct for Expression of the YL DGAT2 Gene Under the Control of the Betaconglycinin Promoter (KS362) (FIG. 3):

Plasmid pKS362 was constructed in many steps from a number of different intermediate vectors. The AscI cassette containing Kti/NotI/Kti3' from pKS121 (PCT Application No. WO 02/00904) was blunted into the NotI (filled in) site on pBluescript II SK+ (Stratagene) to give pKS121/BS. The NcoI/NotI fragment from pDsRed-Express Vector (Clontech) was blunted into the NotI (filled in) site of pKS121/BS to give pDS-RED in KS121/BS (SEQ ID NO:49). The BamHI cassette containing Kti/DsRed/Kti3' in pDS-RED in KS121/BS (SEQ ID NO:50) was ligated into the BamHI site of pKS123 (PCT Application No. WO 02/08269) to give pKS332 (SEQ ID NO:51). The gene for the YL-DGAT2 was synthesized by PCR with primers to introduce NotI sites at both ends of the gene (see Example 1). The resulting PCR product is digested with NotI restriction enzyme and ligated into the NotI site of pKS332 to give pKS362 (SEQ ID NO:52).

Construction of a Control Plasmid (KS352) (FIG. 2):

Based on the sequences of the cloned soybean P34 promoter (WO 2004/071467) (SEQ ID NO:53), two oligos with either BamHI or NotI sites at the 5' ends were designed to re-amplify the P34 promoter. The oligonucleotide sequences of these two oligos are shown as follows:

```
SEQ ID NO: 54 (oP34-1):
CGCGGATCCAACTAAAAAAAGCTCTCAAATTACATTTTGAG

SEQ ID NO: 55 (oP34-2):
GAATTCGCGGCCGCAACTTGGTGGAAGAATTTTATGATTTGAAA
```

The re-amplified P34 promoter fragment was digested with BamHI and NotI, purified and cloned into the BamHI and NotI sites of plasmid pZBL115 (SEQ ID NO:56) to make pJS89 (SEQ ID NO:57). The pZBL115 plasmid contains the origin of replication from pRB322, the bacterial HPT hygromycin resistance gene driven by T7 promoter and T7 terminator, and a 35S promoter-HPT-Nos3' gene to serve as a hygromycin resistant plant selection marker. *Morteriella alpina* delta-6 desaturase gene (U.S. Pat. No. 5,968,809) (SEQ ID NO:58) was cloned into the NotI site of pJS89 (SEQ ID NO:57) in the sense orientation to make the plant expression cassettes and pJS93 (SEQ ID NO:59).

The P34 promoter was excised from pJS93 (SEQ ID NO:59) using SalI NotI double digestion and ligated to SalI/NotI linearized pKS127 vector (U.S. patent application Ser. No. 11/476,510) (SEQ ID NO:60) to give pKS343 (SEQ ID NO:61). The BamHI cassette containing Kti/DsRed/Kti3' in pDS-RED in KS121/BS was blunted and ligated into the HindIII (filled in) site of pKS343 to give pKS352 (SEQ ID NO:62)

Construction of a Plasmid for Co-Expression of YL DGAT1 and YL DGAT2 (KS364):

Plasmid pKS364 (SEQ ID NO:63) was constructed by ligating the 3.3 kb HindIII cassette containing Bcongl PRO/YL-DGAT2/Phas TER from pKS362 (SEQ ID NO:52) into the unique HindIII site downstream of the of the Gy1 promoter in pKS349 (SEQ ID NO:48).

Generation of Transgenic Somatic Embryos:

For co-expression of YL DGAT1 and YL DGAT2 gene in soybean somatic embryos soybean tissue was co-bombarded as described below with a mixture of KS349 and KS362. Briefly, DNA of KS349 was digested with restriction enzymes PstI, XhoI to inactivate the selectable marker gene cassette (CaMV35S PRO/HPT/CaMV NOS TER). This DNA was mixed in a 10:1 ratio with SalI-linearized plasmid DNA of KS362 and used for soybean transformation as outlined below. Alternatively, soybean somatic embryos soybean tissue was bombarded as described below with intact plasmid DNA of KS364 which contains functional expression cassettes for both, YL DGAT1 and YL DGAT2. For expression of YL DGAT1 alone, uncut plasmid DNA of KS349 was used for particle bombardment of embryo tissue. Similarly, for expression of YL DGAT2 alone, uncut plasmid DNA of KS362 was used for particle bombardment of embryo tissue. Moreover, DNA that contained a selectable marker only (KS352) was used for soybean tissue transformation in an identical fashion.

Culture Conditions:

Soybean embryogenic suspension cultures (cv. Jack) were maintained in 35 mL liquid medium SB196 (infra) on a rotary shaker, 150 rpm, 26° C. with cool white fluorescent lights on 16:8 h day/night photoperiod at light intensity of 60-85 µE/m2/s. Cultures were subcultured every 7 days to two weeks by inoculating approximately 35 mg of tissue into 35 mL of fresh liquid SB196 (the preferred subculture interval is every 7 days).

Soybean embryogenic suspension cultures were transformed with the soybean expression plasmids by the method of particle gun bombardment (Klein et al., *Nature* 327:70 (1987)) using a DuPont Biolistic PDS1000/HE instrument (helium retrofit) for all transformations.

Soybean Embryogenic Suspension Culture Initiation:

Soybean cultures were initiated twice each month with 5-7 days between each initiation. Pods with immature seeds from available soybean plants 45-55 days after planting were picked, removed from their shells and placed into a sterilized magenta box. The soybean seeds were sterilized by shaking them for 15 min in a 5% Clorox solution with 1 drop of ivory soap (i.e., 95 mL of autoclaved distilled water plus 5 mL Clorox and 1 drop of soap, mixed well). Seeds were rinsed using 2 1-liter bottles of sterile distilled water and those less than 4 mm were placed on individual microscope slides. The small end of the seed was cut and the cotyledons pressed out of the seed coat. Cotyledons were transferred to plates containing SB199 medium (25-30 cotyledons per plate) for 2 weeks, then transferred to SB1 for 2-4 weeks. Plates were wrapped with fiber tape. After this time, secondary embryos were cut and placed into SB196 liquid media for 7 days.

Preparation of DNA for Bombardment:

Either an intact plasmid or a DNA plasmid fragment containing the genes of interest and the selectable marker gene were used for bombardment.

A 50 µL aliquot of sterile distilled water containing 1 mg of gold particles was added to 5 µL of a 1 µg/µL DNA solution (either intact plasmid or DNA fragment prepared as described above), 50 µL 2.5M CaCl$_2$ and 20 µL of 0.1 M spermidine. The mixture was pulsed 5 times on level 4 of a vortex shaker and spun for 5 sec in a bench microfuge. After a wash with 150 µL of 100% ethanol, the pellet was suspended by sonication in 85 µL of 100% ethanol. Five µL of DNA suspension was dispensed to each flying disk of the Biolistic PDS1000/HE instrument disk. Each 5 µL aliquot contained approximately 0.058 mg gold particles per bombardment (i.e., per disk).

Tissue Preparation and Bombardment with DNA:

Approximately 100-150 mg of 7 day old embryonic suspension cultures were placed in an empty, sterile 60×15 mm petri dish and the dish was placed inside of an empty 150×25 mm Petri dish. Tissue was bombarded 1 shot per plate with membrane rupture pressure set at 650 PSI and the chamber was evacuated to a vacuum of 27-28 inches of mercury. Tissue was placed approximately 2.5 inches from the retaining/stopping screen.

Selection of Transformed Embryos:

Transformed embryos were selected using hygromycin as the selectable marker. Specifically, following bombardment, the tissue was placed into fresh SB196 media and cultured as described above. Six to eight days post-bombardment, the SB196 is exchanged with fresh SB196 containing 30 mg/L hygromycin. The selection media was refreshed weekly. Four to six weeks post-selection, green, transformed tissue was observed growing from untransformed, necrotic embryogenic clusters. Isolated, green tissue was removed and inoculated into multi-well plates to generate new, clonally propagated, transformed embryogenic suspension cultures.

Embryo Maturation:

Transformed embryogenic clusters were cultured for one-three weeks at 26° C. in SB196 under cool white fluorescent (Phillips cool white Econowatt F40/CW/RS/EW) and Agro (Phillips F40 Agro) bulbs (40 watt) on a 16:8 hrphotoperiod with light intensity of 90-120 µE/m$^2$s. After this time embryo clusters were removed to a solid agar media, SB166, for 1 week. Then subcultured to medium SB103 for 3 weeks. Alternatively, embryo clusters were removed to SB228 (SHaM) liquid media, 35 mL in 250 mL Erlenmeyer flask, for 2-3 weeks. Tissue cultured in SB228 was maintained on a rotary shaker, 130 rpm, 26° C. with cool white fluorescent lights on 16:8 h day/night photoperiod at light intensity of 60-85 µE/m2/s. During this period, individual embryos were removed from the clusters and screened for alterations in their fatty acid compositions as described supra.

Media Recipes:

| SB 196 - FN Lite Liquid Proliferation Medium (per liter) | |
| --- | --- |
| MS FeEDTA - 100x Stock 1 | 10 mL |
| MS Sulfate - 100x Stock 2 | 10 mL |
| FN Lite Halides - 100x Stock 3 | 10 mL |
| FN Lite P, B, Mo - 100x Stock 4 | 10 mL |
| B5 vitamins (1 mL/L) | 1.0 mL |
| 2,4-D (10 mg/L final concentration) | 1.0 mL |
| KNO$_3$ | 2.83 gm |
| (NH$_4$)$_2$SO$_4$ | 0.463 gm |
| Asparagine | 1.0 gm |
| Sucrose (1%) | 10 gm |
| pH 5.8 | |

| FN Lite Stock Solutions | | | |
| --- | --- | --- | --- |
| Stock Number | | 1000 mL | 500 mL |
| 1 | MS Fe EDTA 100x Stock | | |
| | Na$_2$ EDTA* | 3.724 g | 1.862 g |
| | FeSO$_4$—7H$_2$O | 2.784 g | 1.392 g |

-continued

| Stock Number | | 1000 mL | 500 mL |
|---|---|---|---|
| 2 | MS Sulfate 100x stock | | |
| | $MgSO_4$—$7H_2O$ | 37.0 g | 18.5 g |
| | $MnSO_4$—$H_2O$ | 1.69 g | 0.845 g |
| | $ZnSO_4$—$7H_2O$ | 0.86 g | 0.43 g |
| | $CuSO_4$—$5H_2O$ | 0.0025 g | 0.00125 g |
| 3 | FN Lite Halides 100x Stock | | |
| | $CaCl_2$—$2H_2O$ | 30.0 g | 15.0 g |
| | KI | 0.083 g | 0.0715 g |
| | $CoCl_2$—$6H_2O$ | 0.0025 g | 0.00125 g |
| 4 | FN Lite P, B, Mo 100x Stock | | |
| | $KH_2PO_4$ | 18.5 g | 9.25 g |
| | $H_3BO_3$ | 0.62 g | 0.31 g |
| | $Na_2MoO_4$—$2H_2O$ | 0.025 g | 0.0125 g |

*Add first, dissolve in dark bottle while stirring

SB1 Solid Medium (Per Liter)

1 package MS salts (Gibco/BRL—Cat. No. 11117-066)
1 mL B5 vitamins 1000× stock
31.5 g Glucose
2 mL 2,4-D (20 mg/L final concentration)
pH 5.7
8 g TC agar

SB199 Solid Medium (Per Liter)

1 package MS salts (Gibco/BRL—Cat. No. 11117-066)
1 mL B5 vitamins 1000× stock
30 g Sucrose
4 ml 2,4-D (40 mg/L final concentration)
pH 7.0
2 gm Gelrite

SB 166 Solid Medium (Per Liter)

1 package MS salts (Gibco/BRL—Cat. No. 11117-066)
1 mL B5 vitamins 1000× stock
60 g maltose
750 mg $MgCl_2$ hexahydrate
5 g Activated charcoal
pH 5.7
2 g Gelrite

SB 103 Solid Medium (Per Liter)

1 package MS salts (Gibco/BRL—Cat. No. 11117-066)
1 mL B5 vitamins 1000× stock
60 g maltose
750 mg MgCl2 hexahydrate
pH 5.7
2 g Gelrite

SB 71-4 Solid Medium (Per Liter)

1 bottle Gamborg's B5 salts w/sucrose (Gibco/BRL—Cat. No. 21153-036)
pH 5.7
5 g TC agar

2,4-D Stock

Obtain premade from Phytotech Cat. No. D 295—concentration 1 mg/mL

B5 Vitamins Stock (Per 100 mL)

Store aliquots at −20° C.
  10 g Myo-inositol
  100 mg Nicotinic acid
  100 mg Pyridoxine HCl
  1 g Thiamine If the solution does not dissolve quickly enough, apply a low level of heat via the hot stir plate.

| SB 228-Soybean Histodifferentiation & Maturation (SHaM) (per liter) | |
|---|---|
| DDI H2O | 600 ml |
| FN-Lite Macro Salts for SHaM 10X | 100 ml |
| MS Micro Salts 1000x | 1 ml |
| MS FeEDTA 100x | 10 ml |
| CaCl 100x | 6.82 ml |
| B5 Vitamins 1000x | 1 ml |
| L-Methionine | 0.149 g |
| Sucrose | 30 g |
| Sorbitol | 30 g |
| Adjust volume to 900 mL | |
| pH 5.8 | |
| Autoclave | |
| Add to cooled media (≦30 C.): | |
| *Glutamine (Final conc. 30 mM) 4% | 110 mL |

*Note: Final volume will be 1010 mL after glutamine addition.

Because glutamine degrades relatively rapidly, it may be preferable to add immediately prior to using media. Expiration 2 weeks after glutamine is added; base media can be kept longer w/o glutamine.

| FN-lite Macro for SHAM 10X-Stock #1 (per liter) | |
|---|---|
| $(NH_4)2SO_4$ (Ammonium Sulfate) | 4.63 g |
| $KNO_3$ (Potassium Nitrate) | 28.3 g |
| $MgSO_4*7H_2O$ (Magnesium Sulfate Heptahydrate) | 3.7 g |
| $KH_2PO_4$ (Potassium Phosphate, Monobasic) | 1.85 g |
| Bring to volume | |
| Autoclave | |

| MS Micro 1000X-Stock #2 (per 1 liter) | |
|---|---|
| $H_3BO_3$ (Boric Acid) | 6.2 g |
| $MnSO_4*H_2O$ (Manganese Sulfate Monohydrate) | 16.9 g |
| $ZnSO4*7H20$ (Zinc Sulfate Heptahydrate) | 8.6 g |
| $Na_2MoO_4*2H20$ (Sodium Molybdate Dihydrate) | 0.25 g |
| $CuSO_4*5H_2O$ (Copper Sulfate Pentahydrate) | 0.025 g |
| $CoCl_2*6H_2O$ (Cobalt Chloride Hexahydrate) | 0.025 g |
| KI (Potassium Iodide) | 0.8300 g |
| Bring to volume | |
| Autoclave | |

| FeEDTA 100X-Stock #3 (per liter) | |
|---|---|
| $Na_2EDTA*$ (Sodium EDTA) | 3.73 g |
| $FeSO_4*7H_2O$ (Iron Sulfate Heptahydrate) | 2.78 g |

*EDTA must be completely dissolved before adding iron.
Bring to Volume
Solution is photosensitive. Bottle(s) should be wrapped in foil to omit light.
Autoclave

| Ca 100X-Stock #4 (per liter) | |
|---|---|
| CaCl$_2$*2H$_2$0 (Calcium Chloride Dihydrate) | 44 g |
| Bring to Volume | |
| Autoclave | |

| B5 Vitamin 1000X-Stock #5 (per liter) | |
|---|---|
| Thiamine*HCl | 10 g |
| Nicotinic Acid | 1 g |
| Pyridoxine*HCl | 1 g |
| Myo-Inositol | 100 g |
| Bring to Volume | |
| Store frozen | |

| 4% Glutamine-Stock #6 (per liter) | |
|---|---|
| DDI water heated to 30° C. | 900 ml |
| L-Glutamine | 40 g |
| Gradually add while stirring and applying low heat. | |
| Do not exceed 35° C. | |
| Bring to Volume | |
| Filter Sterilize | |
| Store frozen* | |

*Note: Warm thawed stock in 31° C. bath to fully dissolve crystals.

Oil Analysis:

Somatic embryos were harvested after two weeks of culture in the liquid maturation medium SB228 (SHaM) liquid media. Approximately 30 events were created in transformations with KS352, KS349/KS362, and KS362 and KS364. All embryos generated for a given event were harvested in bulk and processed as follows. Embryos were frozen on dry ice or by incubation in a −80° C. freezer for two h followed by lyophilization for 48 h.

Dried embryos were ground to a fine powder using a genogrinder vial (½"×2" polycarbonate) and a steel ball (SPEX Centriprep (Metuchen, N.J., U.S.A.). Grinding time was 30 sec at 1450 oscillations per min. For every event, triplicates of approximately 10 mg of tissue were weighed into Eppendorf tubes. The tissue was extracted using 200 µL heptane at room temperature under continuous shaking for 2 h. Heptane extracts were cleared by centrifugation and 25 µL of extract was derivatized to fatty acid methyl esters as follows. One mL of a 25% sodium methoxide stock solution was added to 24 mL of HPLC grade methanol. Sodium methoxide was stored under an inert gas.

Five µL of a 17:0 TAG (Nu-Chek Prep, Elysian, Minn., USA) stock solution (10 mg/mL) was combined with 25 µL of heptane tissue extract in a glass culture tube 500 µL of 1% sodium methoxide was added. Sample were derivatized in a water bath at 50° C. for 15 min. Samples were allowed to cool to RT and 1 mL of 1 M NaCl was added followed by brief mixing. FAMEs were extracted into 1 mL of hepetene and 4 µL sample were quantitated by GC analysis.

Data analysis was performed by plotting the oleic content (% of total FAME) against the total FAME content (% DW). TABLE 8 shows that somatic embryos generated with a vector control (KS352) show little fluctuation in oleic acid content and some fluctuation in oil content that can very likely be attributed to biological variation that in introduced in the regeneration process. For example, embryos very likely show variation in their developmental stage at the time of harvesting. In embryos generated with the control construct no correlation (R2=0.1142) was observed between the oleic acid content and the oil content (TABLE 8). In embryos generated with plasmid constructs expressing YL DGAT1 and YL DGAT2 s gene alone, KS349 and KS362, respectively or both YL DGAT1 and DGAT2 genes (KS349/KS362, KS364) under control of strong seed specific promoters both oleic acid content and total esterified fatty acid content showed a wide range of fluctuation. Moreover, as shown in FIGS. 4 and 5, a strong correlation ($R^2 \geq 0.59$) was observed between the oleic acid content and the total esterified fatty acid content for somatic embryos generated with KS349 and KS362 either alone or in combinations as well as with KS364, a transformation plasmid that contains expression cassettes for YL DGAT1 and YL DAT2 genes.

TABLE 8

Esterified Fatty Acid and Oleic Acid Content of Soybean Somatic Embryos

| Event # | KS 352 FAME (% DCW) | stdv | oleic acid (% total FAME) |
|---|---|---|---|
| 22 | 6.2 | nd | 18.9 |
| 16 | 5.7 | nd | 15.8 |
| 35 | 5.6 | nd | 19.5 |
| 48 | 5.6 | nd | 18.5 |
| 14 | 5.5 | nd | 17.3 |
| 43 | 5.5 | nd | 18.7 |
| 42 | 5.4 | nd | 19.3 |
| 33 | 5.3 | nd | 17.2 |
| 68 | 5.3 | nd | 18.6 |
| 3 | 5.2 | nd | 18.5 |
| 4 | 5.2 | nd | 18.9 |
| 11 | 5.2 | nd | 19.1 |
| 41 | 5.2 | nd | 16.9 |
| 51 | 5.2 | nd | 18.2 |
| 7 | 5.1 | nd | 17.2 |
| 10 | 5.1 | nd | 19.9 |
| 21 | 5.1 | nd | 18.2 |
| 27 | 5.1 | nd | 18.3 |
| 1 | 5.0 | nd | 17.6 |
| 46 | 5.0 | nd | 18.4 |
| 59 | 5.0 | nd | 17.5 |
| 66 | 5.0 | nd | 19.3 |
| 5 | 4.9 | nd | 15.1 |
| 15 | 4.9 | nd | 15.7 |
| 29 | 4.9 | nd | 16.5 |
| 2 | 4.8 | nd | 17.6 |
| 9 | 4.8 | nd | 17.4 |
| 30 | 4.8 | nd | 17.0 |
| 34 | 4.8 | nd | 16.9 |
| 19 | 4.7 | nd | 14.8 |
| 47 | 4.7 | nd | 17.4 |
| 67 | 4.7 | nd | 22.9 |
| 13 | 4.6 | nd | 17.2 |
| 28 | 4.6 | nd | 15.9 |
| 39 | 4.6 | nd | 18.6 |
| 44 | 4.6 | nd | 17.1 |
| 65 | 4.6 | nd | 19.4 |
| 6 | 4.5 | nd | 13.9 |
| 24 | 4.5 | nd | 16.1 |
| 31 | 4.5 | nd | 15.9 |
| 20 | 4.4 | nd | 17.1 |
| 37 | 4.4 | nd | 17.3 |
| 69 | 4.4 | nd | 19.2 |
| 50 | 4.3 | nd | 17.2 |
| 54 | 4.3 | nd | 19.5 |
| 55 | 4.3 | nd | 16.1 |
| 64 | 4.3 | nd | 18.7 |
| 32 | 4.1 | nd | 14.4 |
| 61 | 4.1 | nd | 16.8 |

TABLE 8-continued

Esterified Fatty Acid and Oleic Acid Content of Soybean Somatic Embryos

| Event # | stdv | | oleic acid (% total FAME) |
|---|---|---|---|
| 23 | 4.0 | nd | 16.1 |
| 26 | 4.0 | nd | 13.6 |
| 49 | 4.0 | nd | 16.5 |
| 18 | 3.9 | nd | 16.4 |
| 8 | 3.8 | nd | 15.5 |
| 53 | 3.8 | nd | 20.2 |
| 63 | 3.8 | nd | 17.2 |
| 52 | 3.7 | nd | 17.3 |
| 17 | 3.6 | nd | 14.3 |
| 36 | 3.6 | nd | 15.7 |
| 60 | 3.4 | nd | 16.6 |
| 12 | 3.3 | nd | 15.4 |
| 45 | 3.3 | nd | 15.2 |
| 62 | 3.3 | nd | 18.8 |
| 40 | 3.2 | nd | 13.3 |
| 25 | 3.0 | nd | 12.3 |
| 38 | 3.0 | nd | 16.2 |
| 57 | 2.5 | nd | 18.0 |
| 56 | 2.3 | nd | 18.2 |
| 58 | 2.2 | nd | 16.5 |
| KS349 FAME (% DCW) | | | |
| 28 | 10.8 | 1.0 | 33.2 |
| 16 | 10.6 | 3.1 | 32.7 |
| 25 | 10.3 | 0.9 | 34.1 |
| 19 | 9.7 | 0.2 | 31.5 |
| 8 | 9.5 | 0.9 | 34.7 |
| 7 | 9.4 | 0.3 | 34.3 |
| 18 | 9.3 | 0.1 | 34.3 |
| 30 | 9.2 | 0.0 | 32.3 |
| 3 | 8.6 | 0.6 | 32.9 |
| 20 | 8.5 | 0.1 | 32.9 |
| 24 | 8.4 | 0.1 | 30.8 |
| 5 | 8.3 | 0.3 | 37.0 |
| 21 | 8.2 | 0.5 | 32.5 |
| 12 | 8.1 | 0.3 | 33.2 |
| 31 | 8.1 | 0.2 | 33.4 |
| 11 | 7.5 | 0.5 | 30.5 |
| 6 | 7.5 | 0.2 | 29.9 |
| 22 | 7.5 | 0.7 | 33.2 |
| 27 | 7.1 | 0.4 | 19.4 |
| 29 | 7.1 | 1.5 | 29.9 |
| 23 | 6.6 | 0.3 | 18.4 |
| 17 | 6.3 | 0.7 | 22.7 |
| 15 | 6.0 | 0.1 | 28.1 |
| 4 | 5.7 | 0.1 | 21.2 |
| 13 | 5.7 | 0.0 | 23.6 |
| 14 | 5.6 | 0.2 | 21.7 |
| 26 | 5.5 | 0.1 | 19.1 |
| 10 | 5.5 | 0.1 | 30.8 |
| 2 | 5.5 | 0.3 | 28.2 |
| 9 | 5.2 | 0.2 | 16.6 |
| 1 | 4.6 | 0.3 | 17.1 |
| KS 362 FAME (% DCW) | | | |
| 28 | 14.7 | 0.3 | 28.9 |
| 16 | 14.5 | 0.1 | 33.1 |
| 19 | 14.1 | 0.6 | 32.6 |
| 24 | 13.6 | 0.0 | 29.9 |
| 17 | 13.3 | 0.4 | 31.3 |
| 21 | 12.7 | 0.2 | 28.0 |
| 12 | 12.6 | 0.1 | 30.6 |
| 6 | 11.6 | 1.3 | 32.0 |
| 18 | 11.5 | 0.6 | 26.5 |
| 22 | 10.9 | 0.7 | 23.8 |
| 11 | 10.8 | 0.1 | 27.2 |
| 26 | 10.8 | 0.1 | 25.8 |
| 14 | 10.6 | 0.2 | 25.3 |
| 13 | 10.4 | 0.3 | 22.4 |
| 20 | 9.8 | 0.3 | 21.1 |
| 8 | 9.5 | 0.7 | 21.8 |
| 25 | 9.3 | 0.1 | 19.5 |
| 10 | 9.1 | 0.5 | 21.1 |
| 4 | 8.8 | 0.3 | 23.5 |
| 15 | 8.8 | 0.0 | 19.1 |
| 23 | 7.8 | 0.2 | 16.1 |
| 27 | 7.8 | 0.6 | 18.3 |
| 1 | 7.2 | 0.6 | 20.1 |
| 3 | 7.2 | 0.3 | 18.1 |
| 9 | 7.2 | 0.2 | 14.8 |
| 2 | 6.3 | 0.3 | 17.5 |
| 7 | 6.1 | 0.3 | 22.9 |
| 5 | 4.6 | 0.2 | 17.3 |
| KS349/KS362 FAME (% DCW) | | | |
| 12 | 13.2 | 0.3 | 34.1 |
| 4 | 11.7 | 0.7 | 33.4 |
| 13 | 11.4 | 0.2 | 33.1 |
| 18 | 11.1 | 0.2 | 33.5 |
| 24 | 11.1 | 0.1 | 33.3 |
| 3 | 10.9 | 0.0 | 34.1 |
| 10 | 10.8 | 0.2 | 31.8 |
| 9 | 10.7 | 0.2 | 33.5 |
| 23 | 10.6 | 0.4 | 32.7 |
| 17 | 10.2 | 0.8 | 31.5 |
| 29 | 10.0 | 0.5 | 26.6 |
| 11 | 9.9 | 0.3 | 31.3 |
| 16 | 9.4 | 0.1 | 31.7 |
| 19 | 9.3 | 0.3 | 28.1 |
| 1 | 8.9 | 0.5 | 27.4 |
| 25 | 8.5 | 0.5 | 31.8 |
| 7 | 8.4 | 0.0 | 17.6 |
| 15 | 8.4 | 0.1 | 29.8 |
| 26 | 8.3 | 0.2 | 18.6 |
| 6 | 8.1 | 0.2 | 24.5 |
| 5 | 7.4 | 0.1 | 19.3 |
| 21 | 7.4 | 0.8 | 18.0 |
| 27 | 6.9 | 0.8 | 25.7 |
| 30 | 6.9 | 0.7 | 24.7 |
| 2 | 6.0 | 0.3 | 18.2 |
| 14 | 5.6 | 0.4 | 23.0 |
| 22 | 5.6 | 0.2 | 17.6 |
| 8 | 4.6 | 0.1 | 17.4 |
| 28 | 4.2 | 0.2 | 19.7 |
| 20 | 2.8 | 0.1 | 11.9 |
| KS 364 FAME (% DCW) | | | |
| 21 | 16.1 | 0.9 | 35.9 |
| 29 | 14.6 | 2.1 | 33.8 |
| 18 | 14.2 | 2.3 | 33.2 |
| 27 | 13.4 | 0.8 | 31.7 |
| 20 | 12.2 | 0.8 | 35.6 |
| 28 | 11.8 | 0.7 | 34.6 |
| 26 | 11.5 | 1.6 | 30.8 |
| 3 | 11.3 | 1.0 | 36.2 |
| 22 | 10.9 | 1.4 | 34.0 |
| 1 | 10.7 | 0.6 | 30.8 |
| 24 | 10.7 | 0.6 | 31.2 |
| 25 | 10.6 | 0.2 | 31.2 |
| 6 | 10.2 | 0.4 | 32.6 |
| 2 | 10.1 | 0.3 | 31.0 |
| 5 | 9.9 | 0.5 | 33.3 |
| 11 | 9.8 | 0.4 | 37.8 |
| 12 | 9.8 | 0.6 | 37.0 |
| 8 | 9.4 | 0.1 | 31.5 |
| 10 | 9.3 | 0.1 | 31.2 |
| 15 | 9.2 | 0.4 | 33.7 |
| 16 | 9.1 | 0.2 | 33.9 |
| 19 | 8.7 | 0.1 | 27.3 |
| 7 | 8.4 | 0.6 | 26.7 |

TABLE 8-continued

Esterified Fatty Acid and Oleic Acid Content of Soybean Somatic Embryos

| Event # | stdv | oleic acid (% total FAME) |
|---|---|---|
| 4 | 7.6 | 0.1 | 28.1 |
| 23 | 5.7 | 0.2 | 21.1 |
| 9 | 4.2 | 0.3 | 15.1 |
| 14 | 4.2 | 0.2 | 15.1 |
| 17 | 3.6 | 0.4 | 21.9 |
| 13 | 3.5 | 0.1 | 15.0 |
In summary, the data shows that in soybean somatic embryos, similar to *Arabidopsis* seed YL DGAT gene expression is associated with increased incorporation of oleic acid into the total esterified fatty acid fraction. However, in contrast to *Arabidopsis*, in soybean somatic embryos increased oleic acid content is tightly correlated with total accumulation of esterified fatty acid. In other words, expression of YL DGAT2 alone and co-expression of YL DGAT1 and YL DAGT2 in soybean somatic embryos leads to increased biosynthesis and incorporation of fatty acids into the total esterified fatty acid fraction. Taken together this finding strongly suggests that expression of YL DGAT genes provides an efficient strategy to achieve an increase in the total of oil content of soybean seed.

Example 6

Expression of *Yarrowia lipolytica* DGAT Genes in Soybean Seed

Construction of a control plasmid (KS332) (FIG. 2) containing only CaMV 35S PRO/HPT/NOS TER and Kti PRO/DsRed/Kti TER expression cassettes is described in Example 5. Its sequence is set forth as SEQ ID NO:51.

Transgenic soybean lines were generated by the method of particle gun bombardment (Klein et al., *Nature* (London) 327:70-73 (1987); U.S. Pat. No. 4,945,050) using a BIORAD Biolistic PDS1000/He instrument and plasmid DNA of KS332, KS362 and a 10:1 mixture of KS349 and KS362 prepared as described in Example 3. The following stock solutions and media were used for transformation and regeneration of soybean plants:

Stock Solutions:
Sulfate 100× Stock:
 37.0 g $MgSO_4.7H_2O$, 1.69 g $MnSO_4.H_2O$, 0.86 g $ZnSO_4.7H_2O$, 0.0025 g $CuSO_4.5H_2O$
Halides 100× Stock:
 30.0 g $CaCl_2.2H_2O$, 0.083 g KI, 0.0025 g $COCl_2.6H_2O$
P, B, Mo 100× Stock:
 18.5 g $KH_2PO_4$, 0.62 g $H_3BO_3$, 0.025 g $Na_2MoO_4.2H_2O$
Fe EDTA 100× Stock:
 3.724 g $Na_2EDTA$, 2.784 g $FeSO_4.7H_2O$
2,4-D Stock:
 10 mg/mL Vitamin B5 1000× Stock: 10.0 g myo-inositol, 0.10 g nicotinic acid, 0.10 g pyridoxine HCl, 1 g thiamine.
Media (per Liter):
 SB196: 10 mL of each of the above stock solutions, 1 mL B5 Vitamin stock, 0.463 g $(NH_4)_2 SO_4$, 2.83 g $KNO_3$, 1 mL 2,4-D stock, 1 g asparagine, 10 g Sucrose, pH 5.7
SB103:
 1 pk. Murashige & Skoog salts mixture, 1 mL B5 Vitamin stock, 750 mg $MgCl_2$ hexahydrate, 60 g maltose, 2 g gelrite, pH 5.7.
SB166:
 SB103 supplemented with 5 g per liter activated charcoal.
SB71-4:
 Gamborg's B5 salts, 1 mL B5 vitamin stock, 30 g sucrose, 5 g TC agar, pH 5.7.

To prepare tissue for transformation, soybean embryogenic suspension cultures were maintained in 35 mL liquid medium (SB196) on a rotary shaker (150 rpm) at 28° C. with fluorescent lights providing a 16 h day/8 h night cycle. Cultures were subcultured every two weeks by inoculating approximately 35 mg of tissue into 35 mL of fresh liquid media.

In particle gun bombardment procedures it is possible to use purified 1) entire plasmid DNA; or 2) DNA fragments containing only the recombinant DNA expression cassette(s) of interest. For every seventeen bombardment transformations, 85 µL of suspension is prepared containing 1 to 90 picograms (pg) of plasmid DNA per base pair of each DNA plasmid. Both recombinant DNA plasmids were co-precipitated onto gold particles as follows. The DNAs in suspension were added to 50 µL of a 20-60 mg/mL 0.6 µm gold particle suspension and then combined with 50 µL $CaCl_2$ (2.5 M) and 20 µL spermidine (0.1 M). The mixture was vortexed for 5 sec, spun in a microfuge for 5 sec, and the supernatant removed. The DNA-coated particles were then washed once with 150 µL of 100% ethanol, vortexed and spun in a microfuge again, then resuspended in 85 µL of anhydrous ethanol. Five µL of the DNA-coated gold particles were then loaded on each macrocarrier disk.

Approximately 150 to 250 mg of two-week-old suspension culture was placed in an empty 60 mm×15 mm petri plate and the residual liquid removed from the tissue using a pipette. The tissue was placed about 3.5 inches away from the retaining screen and each plate of tissue was bombarded once. Membrane rupture pressure was set at 650 psi and the chamber was evacuated to −28 inches of Hg. Three plates were bombarded, and, following bombardment, the tissue from each plate was divided between two flasks, placed back into liquid media, and cultured as described above.

Seven days after bombardment, the liquid medium was exchanged with fresh SB196 medium supplemented with 30-50 mg/L hygromycin. The selective medium was subsequently refreshed weekly or biweekly. Seven weeks postbombardment, bright green, transformed tissue was observed growing from untransformed, chlorotic or necrotic embryogenic clusters. Isolated green tissue was removed and inoculated into individual wells in six-well culture dishes to generate new, clonally-propagated, transformed embryogenic suspension cultures. Thus, each new line was treated as independent transformation event in an individual well. These suspensions can then be maintained as suspensions of embryos clustered in an immature developmental stage through subculture or they can be regenerated into whole plants by maturation and germination of individual somatic embryos.

After two weeks in individual cell wells, transformed embryogenic clusters were removed from liquid culture and placed on solidified medium (SB166) containing no hormones or antibiotics for one week. Embryos were cultured for at 26° C. with mixed fluorescent and incandescent lights on a 16 h day/8 h night schedule. After one week, the cultures were then transferred to SB103 medium and maintained in the same growth conditions for 3 additional weeks.

Somatic embryos became suitable for germination after four weeks and were then removed from the maturation medium and dried in empty petri dishes for one to five days. The dried embryos were then planted in SB71-4 medium where they were allowed to germinate under the same light and temperature conditions as described above. Germinated embryos were transferred to sterile soil and grown to maturity for seed production.

A total of 29 transgenic lines with seed were generated with intact plasmid DNA of KS362 at concentration of 15 pg per bp of plasmid DNA per gold particle preparation (see above). For every event 20 seed were scored for the presence of the DS marker gene. Briefly, seeds were observed under a stereo microscope (Leica MZ Fluo III) using a UV light source. A filter set customized for fluorescence associated with DsRed expression with the following properties was used: Exitation λ=540-580 nm/Emssion λ≧570 nm. In cases were less that 20 seed were available all seed were scored in this manner. Subsequently soybean seed oil content was measured by NMR as described previously 3. Nineteen events generated with KS362 contained seed that were positive for DsRed. Of these, 11 events showed a detectable difference in oil content between DsRed positive transgenic segregants and DsRed negative null segregants. Data are summarized in TABLE 9.

TABLE 9

Oil Content of T1 Soybean Seed Generated with KS362

| | n | avg % oil null | n | avg % oil DsRed+ | delta % points | delta % |
|---|---|---|---|---|---|---|
| AFS4822.4.5.1 | 5 | 13.3 | 15 | 20.4 | 7.2 | 54.1 |
| AFS4822.3.2.1 | 10 | 14.2 | 9 | 18.9 | 4.7 | 32.7 |
| AFS4822.3.3.1 | 5 | 12.4 | 8 | 16.1 | 3.7 | 29.5 |
| AFS4822.4.2.1 | 4 | 16.2 | 6 | 20.9 | 4.7 | 29.3 |
| AFS4822.4.1.1 | 9 | 15.1 | 8 | 19.4 | 4.3 | 28.9 |
| AFS4822.1.13.1 | 5 | 15.3 | 15 | 19.1 | 3.7 | 24.4 |
| AFS4822.1.2.1 | 2 | 15.8 | 18 | 19.6 | 3.8 | 24.1 |
| AFS4822.4.17.1 | 7 | 14.9 | 13 | 18.5 | 3.6 | 23.9 |
| AFS4822.1.9.1 | 8 | 16.9 | 12 | 19.8 | 3.0 | 17.5 |
| AFS4822.2.11.1 | 6 | 17.9 | 14 | 20.7 | 2.8 | 15.7 |
| AFS4822.2.10.1 | 6 | 20.6 | 14 | 23.5 | 2.8 | 13.7 |

A total of 10 transgenic lines with seed were generated with DNA of KS332. For every event 20 seed were scored for the presence of the DS marker gene as described above. In cases were less that 20 seed were available all seed were scored in this manner. Subsequently soybean seed oil content was measured by NMR as described in Example 4. Seven events generated with KS 332 contained seed that were positive for DsRed. Data are summarized in TABLE 10.

TABLE 10

Oil Content of T1 Soybean Seed Generated with KS332

| | n | avg % oil null | n | avg % oil DsRed+ | delta % points | delta % |
|---|---|---|---|---|---|---|
| AFS4703.1.1.1 | 3 | 21.8 | 17 | 20.5 | −1.4 | −6.2 |
| AFS4703.1.2.1 | 4 | 20.8 | 16 | 18.5 | −2.3 | −11.2 |
| AFS4703.1.6.1 | 5 | 20.4 | 15 | 21.4 | 1.0 | 5.0 |
| AFS4703.2.3.1 | 8 | 22.1 | 12 | 21.1 | −0.9 | −4.1 |
| AFS4703.2.4.1 | 6 | 22.2 | 14 | 21.7 | −0.4 | −2.0 |
| AFS4703.3.8.1 | 6 | 21.8 | 14 | 21.8 | 0.0 | 0.2 |
| AFS4703.3.16.1 | 5 | 23.9 | 15 | 23.3 | −0.6 | −2.5 |

In contrast to seed generated with KS362, for transgenic seed generated with KS332 no consistent oil increase could be associated with the presence of the DsRed marker in T1 segregants.

Four events generated with KS362 were subjected to analysis of DsRed status and oil NMR of all available T1 seed. Data are summarized in TABLE 11.

TABLE 11

Oil Content of T1 Soybean Seed Generated with KS362

| | n | avg % oil null | n | avg % oil DS red+ | delta % points | delta % |
|---|---|---|---|---|---|---|
| AFS4822.4.5.1 | 8 | 12.0 | 24 | 18.3 | 6.3 | 52.9 |
| AFS4822.1.13.1 | 17 | 15.0 | 42 | 18.7 | 3.7 | 24.6 |
| AFS4822.1.2.1 | 4 | 15.7 | 40 | 19.3 | 3.5 | 22.3 |
| AFS4822.2.10.1 | 8 | 19.5 | 25 | 23.0 | 3.5 | 17.8 |
| AFS4822.2.11.1 | 6 | 17.9 | 17 | 20.3 | 2.4 | 13.5 |

In summary, the data in the previous tables and FIG. 7 show that seed specific expression of YL DAGT2 leads to increased oil biosynthesis during soybean seed maturation and thus provides an efficient metabolic engineering tool to increase oil accumulation in soybeans.

A total of 16 transgenic lines with seed were generated by co-bombardment with DNA of KS349 and KS362 that had been mixed at a 10:1 ratio (see Example 4). The DNA mixture was delivered in soybean transformation at a final concentration of 15 pg per bp of plasmid DNA per gold particle preparation. Briefly, prior to bombardment DNA KS349 was digested with PstI, XhoI for inactivation of the selectable marker gene on this plasmid. DNA of KS362 was linearized with SalI. It is reasonable to assume that because of the pre-treatment of the DNA, the selectable marker gene in all transformations was delivered from the plasmid (KS362) that was bombarded at the lower DNA concentration. Initial inspection of these seed under the fluorescence stereo-microcsope revealed that very few events of this transformation contained T1 seed that were positive for the DsRed marker gene. This result may be due to the proximity of the DsRed expression cassette to the end of the SalI restriction fragment of KS362 that was used for soybean transformation. It may have resulted in the integration of KS362 DNA fragments that did not contain a functional DsRed expression cassette. For this reason T1 seed were screened for the absence of presence of the transgene-derived YL DGAT by assaying the seed fatty acid composition. For every event 20 seed were analyzed by GC. 50 seed of untransformed soybean seed were processed in the same manner. Soybean seed chips were produced by cutting the seed with a razorblade avoiding the embryonic axis. Seed chips of approximately 2 mg were placed in a vial containing 50 µL trimethylsulfonium hydroxide and 0.5 mL hexane. The chips were incubated for 30 min at room temperature while shaking. 5 µL of the hexane layer was injected into a Hewlett Packard 6890 Gas Chromatograph containing a Omegawax 320 fused silica capillary column (Supelco Cat. No. 24152). Oven conditions were as follows: initial temperature of 220° C. for 2.7 minutes, ramped to 240° C. over 1 min and held at 240° C. For a total run time of 6 min. Retention times were compared to standards commercially available (Nu-Chek Prep, Inc. Cat. No. U-99-A). Fatty acids were determined by direct transesterification of individual standards in 0.5 mL of methanolic $H_2SO_4$ (2.5%). Fatty acid methyl esters were extracted from the methanolic solutions into hexane after the addition of an equal volume of water.

Ten events were identified that contained T1 seed with ≧25% oleic acid content. Since this oleic acid content was not observed in untransformed soybean seed (see FIG. 6 and TABLE 12) and increased oleic acid content was previously associated with YL DGAT2 and YL DGAT1 and YL DGAT2 co-expression both in *arabidopsis* seed and soybean somatic embryos, it is believed that the presence of oleic acid at levels of ≧25% provides efficient means to identify YL DGAT positive T1 seed. After GC analysis for YL DGAT genotyping, seed were subjected to oil measurements by NMR as described previously (Example 3). When oleic acid content was plotted against total oil content seven of the 10 events with T1 seed of ≧25% showed a correlation of $R^2 \geq 0.3$ between oil and oleic acid content. The properties of these events are described in more detail in TABLE 12.

TABLE 12

Oil Content of T1 Soybean Seed Generated with KS349/KS362

|  | n | avg % oil <25% oleic | n | avg % oil ≧25% oleic | delta % points | delta % | $R^2$ % oleic/% oil |
|---|---|---|---|---|---|---|---|
| AFS4818.3.1.1 | 15 | 11.9 | 5 | 16.8 | 4.9 | 41.0 | 0.38 |
| AFS4818.1.5.1 | 10 | 15.5 | 10 | 20.0 | 4.5 | 28.7 | 0.69 |
| AFS4818.2.10.1 | 10 | 13.2 | 10 | 16.5 | 3.3 | 25.2 | 0.39 |
| AFS4818.1.9.1 | 5 | 12.9 | 14 | 15.9 | 3.0 | 22.9 | 0.51 |
| AFS4818.2.6.1 | 12 | 18.6 | 8 | 21.9 | 3.4 | 18.1 | 0.51 |
| AFS4818.1.3.1 | 6 | 20.5 | 14 | 23.6 | 3.1 | 14.9 | 0.45 |
| AFS4818.1.2.1 | 6 | 19.4 | 14 | 21.8 | 2.4 | 12.4 | 0.37 |
| Jack (wt control) | 56 | 21.7 |  |  |  |  | 0.003 |

Jack wild type seed were grown under similar condition to those used for T1 seed generation and analyzed by GC and NMR analysis. It was observed that oleic acid and oil content fluctuated between 7.6-20.5% and 18.6-25.2%, respectively. No correlation between oleic acid content and oil content could be observed in untransformed soybean seed.

Four events generated with KS349/KS362 were subjected to GC and NMR analysis of all available T1 seed. Data are summarized in TABLE 13.

TABLE 13

Oil Content of T1 Soybean Seed Generated with KS349/KS362

|  | n | avg % oil <25% oleic | n | avg % oil ≧25% oleic | delta % points | delta % | $R^2$ % oleic/% oil |
|---|---|---|---|---|---|---|---|
| AFS4818.1.5.1 | 21 | 16.3 | 21 | 20.2 | 3.9 | 23.8 | 0.55 |
| AFS4818.2.6.1 | 49 | 18.1 | 23 | 21.9 | 3.7 | 20.7 | 0.50 |
| AFS4818.1.3.1 | 33 | 20.2 | 67 | 23.5 | 3.3 | 16.2 | 0.43 |
| AFS4818.1.2.1 | 13 | 19.3 | 26 | 22.1 | 2.7 | 14.1 | 0.45 |

Taken together the data in the previous tables and FIGS. 6 and 7 strongly support the conclusion that co-expression of YL DGAT1 and YL DGAT2 genes, like expression of the YL DGAT2 gene alone, provides an efficient strategy to achieve an increase in the total of oil content of soybean seed. Additionally, it should be noted that a high number of events could be identified with an oil difference of ≧2% points between null and transgenic segregants among a small set of transgenic events screened.

Example 7

Expression of *Yarrowia lipolytica* DGAT Genes in Maize

Based on results disclosed in Examples 4, 5 and 6 of the instant application, the YL DGAT1 and YL DGAT2 genes can be expressed in the seed embryo of maize to increase the oil content of this tissue. As described below, this result can be achieved by transforming maize with expression cassettes comprising open reading frames of DGAT1 and DGAT2 from *Yarrowia lipolytica* operably linked on their 5' ends to embryo preferred promoters, such as the promoter for the maize 16 kDa oleosin gene (Lee, K. and Huang, A. H., *Plant Mol. Biol.* 26:1981-1987 (1984)) and maize embryo abundant (EAP1) promoter and terminator (US 2006272058 A1).

An expression cassette comprising the promoter from the maize 16 kDa oleosin gene (OLE PRO), the coding sequence of the YL DGAT2 gene (SEQ ID NO:9) and the polyadenylation signal sequence/terminator from the nopaline synthase (NOS) gene of *Agrobacterium tumefaciens* is constructed using methods and technologies known in the art. A second expression cassette comprises the YL DGAT1 gene under the transcriptional control of the maize embryo abundant protein (EAP1) promoter and terminator, with the maize ADH1 INTRON1 inserted between the promoter and coding sequence for enhanced expression. The two expression cassettes are linked, together with a gene encoding a selectable marker, in a binary vector suitable for *Agrobacterium*-mediated transformation of maize.

An *Agrobacterium*-based protocol can be used for the transformation of maize (see below). The resulting binary vector is introduced into *Agrobacterium* LBA4404 (PHP10523) cells, preferably by electroporation. An in vivo recombination generates a cointegrate plasmid between the introduced binary vector and the vir plasmid (PHP10523) resident in the *Agrobacterium* cells. The resulting *Agrobacterium* cells are used to transform maize.

Transformation of Maize Mediated by *Agrobacterium*:

Freshly isolated immature embryos of maize, about ten days after pollination (DAP), can be incubated with the *Agrobacterium*. The preferred genotype for transformation is the highly transformable genotype Hi-II (Armstrong, *Maize Gen. Coop. Newsletter* 65:92-93 (1991)). An F1 hybrid created by crossing a Hi-II with an elite inbred may also be used. After *Agrobacterium* treatment of immature embryos, the embryos can be cultured on medium containing toxic levels of herbicide. Only those cells that receive the herbicide resistance gene, and the linked gene(s), grow on selective medium. Transgenic events so selected can be propagated and regenerated to whole plants, produce seed, and transmit transgenes to progeny.

Preparation of *Agrobacterium*:

The engineered *Agrobacterium tumefaciens* LBA4404 can be constructed to contain plasmids for seed-preferred expression of YL DGAT1 and YL DGAT2 genes, as disclosed in U.S. Pat. No. 5,591,616 (the contents of which are hereby incorporated by reference). To use the engineered construct in plant transformation, a master plate of a single bacterial colony transformed with plasmids for seed-preferred expression of YL DGAT1 and YL DGAT2 genes can be prepared by inoculating the bacteria on minimal AB medium and allowing incubation at 28° C. for approximately three days. (The composition and preparation of minimal AB medium has been previously described in PCT Publication No. WO 02/009040 (the contents of which are hereby incorporated by reference).

A working plate can then be prepared by streaking the transformed *Agrobacterium* on YP medium (0.5% (w/v) yeast extract, 1% (w/v) peptone, 0.5% (w/v) sodium chloride, 1.5% (w/v) agar) that contains 50 µg/mL of spectinomycin.

The transformed *Agrobacterium* for plant transfection and co-cultivation can then be prepared one day prior to maize transformation. Into 30 mL of minimal A medium (prepared as described in PCT Publication No. WO 02/009040) in a flask was placed 50 µg/mL spectinomycin, 100 µM acetosyringone, and about a ⅛ loopful of *Agrobacterium* from a one to two-day-old working plate. The *Agrobacterium* can then be grown at 28° C. with shaking at 200 rpm for approximately fourteen h. At mid-log phase, the *Agrobacterium* can be harvested and resuspended at a density of 3 to 5×10⁸ CFU/mL in 561Q medium that contains 100 μM acetosyringone using standard microbial techniques. The composition and preparation of 561Q medium was described in PCT Publication No. WO 02/009040.

Immature Embryo Preparation:

Nine to ten days after controlled pollination of a maize plant, developing immature embryos are opaque and 1-1.5 mm long. This length is the optimal size for infection with the PHP18749-transformed *Agrobacterium*. The husked ears can be sterilized in 50% commercial bleach and one drop Tween-20 for thirty minutes, and then rinsed twice with sterile water. The immature embryos can then be aseptically removed from the caryopsis and placed into 2 mL of sterile holding solution consisting of medium 561Q that contains 100 μM of acetosyringone.

*Agrobacterium* Infection and Co-Cultivation of Embryos:

The holding solution can be decanted from the excised immature embryos and replaced with transformed *Agrobacterium*. Following gentle mixing and incubation for about five minutes, the *Agrobacterium* can be decanted from the immature embryos. Immature embryos were then moved to a plate of 562P medium, the composition of which has been previously described in PCT Publication No. WO 02/009040. The immature embryos can be placed on this media scutellum surface pointed upwards and then incubated at 20° C. for three days in darkness. This step can be followed by incubation at 28° C. for three days in darkness on medium 562P that contains 100 μg/mL carbenecillin as described in U.S. Pat. No. 5,981,840.

Selection of Transgenic Events:

Following incubation, the immature embryos can be transferred to 5630 medium, which can be prepared as described in PCT Publication No. WO 02/009040. This medium contains Bialaphos for selection of transgenic plant cells as conferred by the BAR gene that is linked to barley HGGT expression cassette. At ten to fourteen-day intervals, embryos were transferred to 5630 medium. Actively growing putative transgenic embryogenic tissue can be after six to eight weeks of incubation on the 5630 medium.

Regeneration of $T_0$ Plants:

Transgenic embryogenic tissue is transferred to 288 W medium and incubated at 28° C. in darkness until somatic embryos matured, or about ten to eighteen days. Individual matured somatic embryos with well-defined scutellum and coleoptile are transferred to 272 embryo germination medium and incubated at 28° C. in the light. After shoots and roots emerge, individual plants are potted in soil and hardened-off using typical horticultural methods.

288 W medium contains the following ingredients: 950 mL of deionized water; 4.3 g of MS Salts (Gibco); 0.1 g of myo-inositol; 5 mL of MS Vitamins Stock Solution (Gibco); 1 mL of zeatin (5 mg/mL solution); 60 g sucrose; 8 g of agar (Sigma A-7049, Purified), 2 mL of indole acetic acid (0.5 mg/mL solution*); 1 mL of 0.1 mM ABA*; 3 mL of Bialaphos (1 mg/mL solution*); and 2 mL of carbenicillin (50 mg/mL solution). The pH of this solution is adjusted to pH 5.6. The solution is autoclaved and ingredients marked with an asterisk (*) are added after the media has cooled to 60° C.

Medium 272 contains the following ingredients: 950 mL of deionized water; 4.3 g of MS salts (Gibco); 0.1 g of myo-inositol; 5 mL of MS vitamins stock solution (Gibco); 40 g of Sucrose; and 1.5 g of Gelrite. This solution is adjusted to pH 5.6 and then autoclaved.

Example 8

Analysis of Kernel Oil Content

Nuclear Magnetic Resonance (NMR) Analysis:

Seed are imbibed in distilled water for 12-24 hours at 4° C. The embryo is dissected away and stored in a 48 well plate. The samples are lyophilized overnight in a Virtis 24×48 lyophilizer. The NMR (Process Control Technologies—PCT (Ft. Collins, Colo.) is set up as per the manufacturer's instructions. The NMR is calibrated using a series of 5 mm NMR tubes containing precisely measured amounts of corn oil (Mazola). The calibration standards are 3, 6, 9, 12, 15, 18, 21, 27, 33, and 40 mg of oil.

Example 9

Synthesis of YL DGAT1 and YL DGAT2 Genes

Nucleotide sequences encoding YL DGAT1 and YL DGAT2 were designed for optimized expression in soybean seed using methods similar to those described in Wu, G et al. *Nucleic Acids Research* (2007), 35: D76-D79; Villalobos, A. et al. *BMC Bioinformatics* (2006), 7 No pp. given; Wu, G. et al. *Protein Expression and Purification* (2006), 47: 441-445; Richardson, S. M. et al. *Genome Research* (2006), 16: 550-556; Jayaraj, S. et al. *Nucleic Acids Research* (2005) 33: 3011-3016. DNA molecules were synthezised by DNA 2.0 (Menlo Park, Calif., USA). Expression-optimized DNA sequences of YL DGAT1 and YL DGAT2 are set forth in SEQ ID NO:64 and SEQ ID NO:66, respectively. The amino acid sequences for soy optimized enzymes are set forth in SEQ ID NO:65 (YL DGAT1) and SEQ ID NO:67 (YL DGAT2) and are identical to the translation products of SEQ ID NO:1 and SEQ ID NO:9, respectively.

Example 10

Fatty Acid Composition of Soybean Somatic Embryos Expressing YL DGAT Genes

Transgenic somatic embryos were generated using the plasmid constructs KS352, KS349, KS362 and KS364. Generation of the DNA constructs and the transformation process is described in detail in EXAMPLE 5. Fatty acid composition was determined by GC analysis of fatty acid methyl esters generated by sodium methoxide derivatization of heptane extracts. The findings are summarized in TABLE 14. The table compares the fatty acid composition of 100 events generated with a control plasmid lacking YL DGAT genes with that of events created with plasmids containing YL DGAT1 (KS349), YL DGAT2 (KS362) or both genes (KS364). For events generated with YL DGAT containing DNA constructs the average fatty acid composition of all events with greater than 30% oleic is shown.

TABLE 14

Fatty Acid Composition of Soybean Somatic Embryos generated with KS 352, 349, 362, 349&362 and 364

| Plasmid | n | palmitic acid | stearic acid | oleic acid | linoleic acid | linolenic acid |
|---|---|---|---|---|---|---|
| KS352 average | 100 | 15.9 | 5.2 | 17.9 | 44.1 | 16.9 |
| KS352 range | | 12.6-20.8 | 4.2-6.6 | 12.3-22.9 | 39.3-46.9 | 12.4-23.5 |

TABLE 14-continued

Fatty Acid Composition of Soybean Somatic Embryos generated with KS 352, 349, 362, 349&362 and 364

| Plasmid | n | palmitic acid | stearic acid | oleic acid | linoleic acid | linolenic acid |
|---|---|---|---|---|---|---|
| KS349 average (>30% oleic) | 18 | 11.6 | 5.4 | 33.0 | 41.3 | 8.6 |
| KS349 range (>30% oleic) | | 10.7-12.8 | 4.2-6.5 | 30.5-37.0 | 38.7-44.6 | 7.8-10.7 |
| KS362 average (>30% oleic) | 5 | 11.5 | 6.3 | 31.9 | 43.2 | 6.9 |
| KS362 range (>30% oleic) | | 10.9-12.7 | 5.7-7.0 | 30.6-33.1 | 41.9-44.8 | 6.2-7.7 |
| KS349&362 average (>30% oleic) | 14 | 12.8 | 5.4 | 33.8 | 39.7 | 8.4 |
| KS349&362 range (>30% oleic) | | 11.5-14.4 | 3.8-7.0 | 30.8-35.5 | 38-42.7 | 6.3-10.3 |
| KS364 average (>30% oleic) | 14 | 10.9 | 6.4 | 39.0 | 38 | 5.7 |
| KS364 range (>30% oleic) | | 9.2-12.6 | 5.9-7.7 | 32.8-48.6 | 31.4-42.7 | 3.2-6.5 |

The table shows that expression of YL DGAT1 or YL DGAT2 as well as co-expression of these genes alters the FA profile of soybean somatic embryos. The most pronounced alteration is an increase in oleic acid and a decrease in linolenic acid that is consistently observed with all DNA constructs tested. Expression of YL DGAT genes also leads to a decrease in palmitic and linoleic acid and an increase in stearic acid.

Example 11

Fatty Acid Composition of Soybean Seed Expressing YL DGAT Genes

Event AFS4822.1.13.1 was generated using plasmid DNA of KS362 as described in EXAMPLE 6. Transgenic T1 seed show an increase in oil content of 24.6% when compared to null segregant seed from the same T1 plant. This observation strongly supports the conclusion that this events expresses YL DGAT2. T1 seed of AFS4822.1.13.1 with or without the YL DGAT2 transgene were germinated and grown in the growth chamber for three month. DS-red positive T1 seed of event AFS4703.1.6 were germinated and grown alongside the YL DGAT2 event. AFS4703.1.6 was generated with KS332, a plasmid vector hat contains the DS-red marker gene but does not contain YL DGAT2 (see EXAMPLE 5). Several T1 segregants could be identified that only produced DS-red positive T2 seed indicating that these lines were homozygous for the respective transgene. T2 seed harvested from null-segregant progeny were DS-red negative confirming that these lines likely did not contain a functional transgene.

For each selection six seeds were chipped and the fatty acid composition of the seed chips was analyzed by TMSH-derivatization followed by gas chromatography as described in EXAMPLE 6. TABLE15A compares the average fatty acid composition of six seed chips of DS-red positive segregants of AFS4822.1.13.1 with that of seed chips derived form a null-segregant plant and that of seed chips of event AFS4703.1.6 containing only the DS-red marker gene. It demonstrates that expression of YL DGAT2 alters the FA profile of soybean seed. The most pronounced alteration is an increase in oleic acid and a decrease in linolenic acid. Expression of YL DGAT genes also leads to a decrease in palmitic and linoleic acid and an increase in stearic acid.

TABLE 15A

Fatty Acid Composition of T2 Soybean Seed Generated with KS362

| Event | n | palmitic acid | stearic acid | oleic acid | linoleic acid | linolenic acid |
|---|---|---|---|---|---|---|
| AFS4822.1.13.1 average (DS red positive) | 6 | 10.8 | 4.6 | 29.2 | 49.5 | 6.0 |
| AFS4822.1.13.1 average (Null segregant) | 6 | 12.0 | 3.4 | 16.3 | 59.0 | 9.4 |
| AFS4703.1.6 average (DS red positive) | 6 | 11.5 | 3.3 | 15.8 | 59.8 | 9.6 |

TABLE 15B

Fatty Acid Composition of T2 Soybean Seed Generated by co-transformation with KS349 and KS362

| Event | n | palmitic acid | stearic acid | oleic acid | linoleic acid | linolenic acid |
|---|---|---|---|---|---|---|
| AFS4818.1.9 average | 58 | 10.8 | 4.5 | 27.9 | 49.6 | 7.2 |
| AFS4818.1.9 average (Null segregant) | 42 | 12.2 | 3.4 | 14.3 | 57.0 | 13.0 |
| AFS4818.1.3 average | 34 | 10 | 4.2 | 31.6 | 48.7 | 5.5 |
| AFS4818.1.3 average (Null segregant) | 14 | 11.4 | 3.0 | 16.4 | 58.7 | 10.5 |

Figures 8A, 8B:
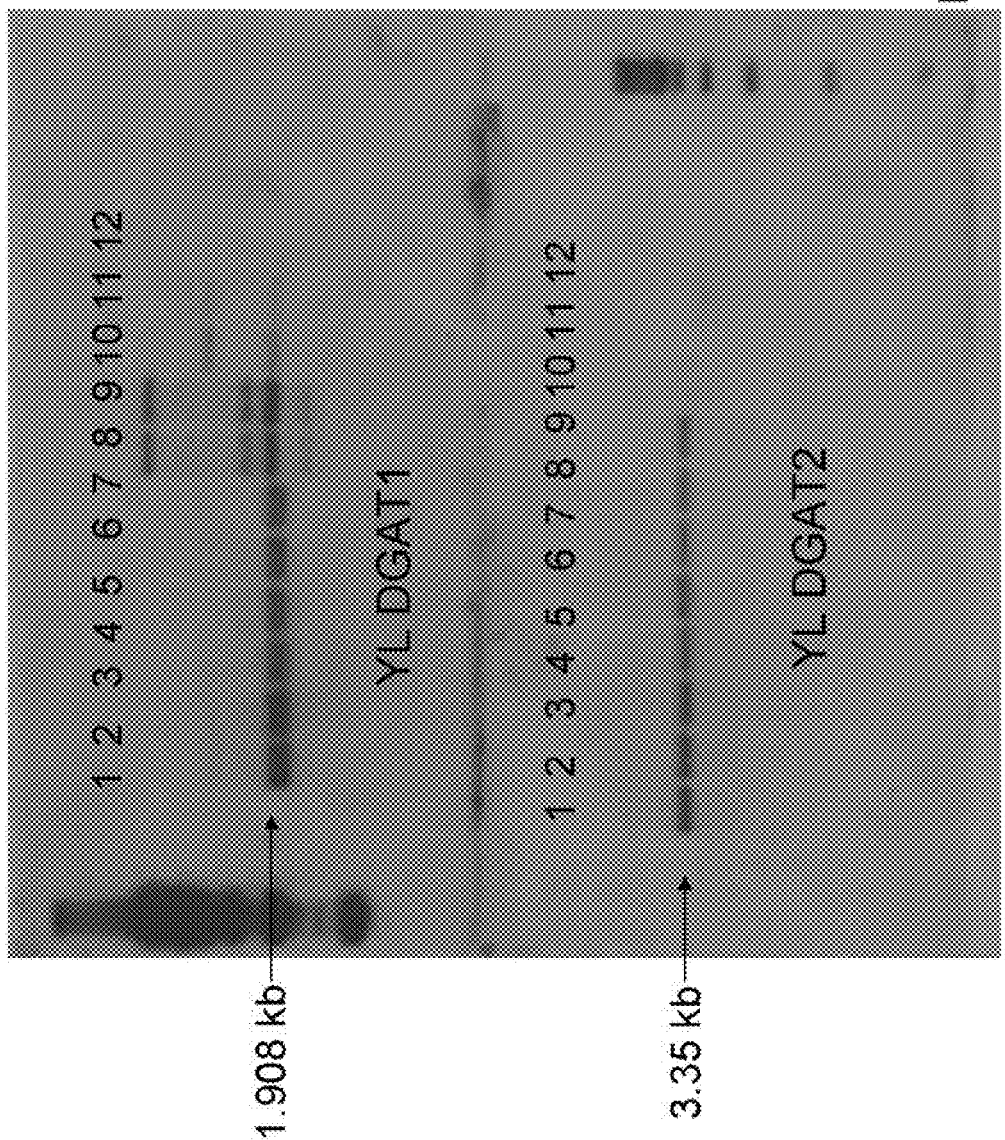

Events AFS4818.1.9 and AFS4818.1.3 were generated using a mixture of DNA fragments derived from plasmids KS349 (YL DGAT1) and KS362 (YL DGAT2) as described in EXAMPLE 5. Transgenic T1 seed of these two events show an increase in oil content of 22.9 and 16.2%, respectively when compared to null segregant seed from the same T1 plant. Although this observation strongly supports the conclusion that both events express transgene derived YL DGAT it is not clear if both events contain intact copies of both or just one DGAT gene present in the DNA mixture used for transformation. T1 seed with increased oil and oleic acid content (see Example 6) were planted for events AFS4818.1.2, AFS4818.1.3, AFS4818.1.5, AFS48182.6, AFS4818.1.9. DNA was isolated, digested with the two restriction enzymes EcoRI and HindIII and transferred to nylon membranes using standard protocols. Duplicate blots were produced and hybridized independently with probes corresponding to a 1.21 kb restriction fragment of the YL DGAT1 gene (generated by digestion of KS349 with NcoI/EcoRI) and the intact YL DGAT2 genes (generated by NotI digestion of KS 362). Based on the sequence of KS 349 (SEQ ID NO:48) and KS 362 (SEQ ID NO: 52) insertion of an intact copy of YL DGAT1 and YL DGAT2 gene in the soybean genome would be indicated by a strong hybridization signal of restriction fragments with a size of ≧1.908 and ≧3.335 kb, respectively. In keeping with this, all events showed strongly hybridizing bands of ≧1.908 kb when a YL DGAT1 probe was used (FIG. 8A). No hybridization signal was observed when DNA from unmodified soybeans was used (lanes 11 and 12, FIGS. 8A and B). This demonstrates that all events tested have insertions of at least one copy of the intact YL DGAT1 expression cassette present on KS 349. However when DNA of YL DGAT2 was used in hybridization experiments, event 4818.1.9 did only show a very weakly hybridizing band of high MW whereas all other events tested showed strongly hybridizing bands of ≧3.335 kb (lane 9, FIG. 8B). Next genomic DNA of all five events was digested with BstXI, transferred to nylon membranes and probed with intact YL DGAT2 DNA generated as described above (FIG. 9). Insertion of an intact copy of the YL DGAT2 expression cassette would be indicated by strongly hybridizing bands of 0.584 kb (internal fragment) and additional fragments of ≧0.2 and ≧0.77 kb. All events except 4818.1.9 show the hybridization pattern indicative of complete insertion of YL DGAT2. It was concluded that 4818.1.9 only contains a functional expression unit for YL DGAT1.

T1 plants of events 4818.1.9 and 4818.1.3 that were derived from seed with increased oil and oleic acid content of event 4818.1.9 and 4818.1.3 were grown to maturity and seed were harvested. Fatty acid composition of T2 seed was determined by TMSH-derivatization and GC analysis of seed chips derived from T2 seed. Table compares fatty acid composition of transgenic and null segregant seed from a T2 plant of 4818.1.9 and 4818.1.3 (Table 15B). It demonstrates that expression of YL DGAT1 as well as co-expression of YL DGAT1 and YL DGAT2 alters the FA profile of soybean seed. The most pronounced alteration is an increase in oleic acid and a decrease in linolenic acid. Expression of YL DGAT genes also leads to a decrease in palmitic and linoleic acid and an increase in stearic acid.

Example 12

Analysis of Transgenic Events: Growth Chamber

The present example describes measurements of oil content of soybean derived form T2 plants that were homozygous or heterozygous for transgenes comprising YL DGAT1 or YL DGAT2 or both YL DGAT genes. T2 plants were grown in a controlled environment (growth chamber).

Oil analysis of T2 soybean seed derived from plants grown in a plant growth chamber was performed by NMR. Seed were harvested form individual plants. Seed selections from heterozygous plants derived form transformations with the DGAT2 gene from *Yarrowia* showed segregation of the DS red marker. Oil content of DS red positive seed (with DGAT2 transgene) and null segregant seed from the same plant is shown in Table 16. In said table oil content of seed containing the DGAT2 transgene is compared to that of non-transgenic null segregant seed from the same plant.

TABLE 16

Oil content of transgenic seed and null segregant seed derived from transgenic soybean T2 plants that segregate for transgene with the *yarrowia* DGAT2 gene

| Event | PLANT | average oil (%) w transg. | n | average oil (%) null | n | Δ % points | Δ % |
|---|---|---|---|---|---|---|---|
| 4822.1.13 | A | 22.2 | 37 | 19.6 | 11 | 2.3 | 11.5 |
| | B | 21.4 | 27 | 19.5 | 13 | | |
| | average | 21.8 | | 19.6 | | | |
| 4822.4.5 | A | 22.3 | 35 | 18.4 | 13 | 3.6 | 19.6 |
| | B | 22.5 | 38 | 18.5 | 10 | | |
| | C | 21.7 | 31 | 17.7 | 17 | | |
| | D | 22.7 | 31 | 18.2 | 17 | | |
| | E | 21.7 | 23 | 18.9 | 17 | | |
| | average | 22.2 | | 18.6 | | | |
| 4822.1.9 | A | 22.9 | 33 | 20.4 | 7 | 2.5 | 12.3 |
| 4822.2.10 | A | 24.3 | 62 | 20.1 | 24 | 3.3 | 16.3 |
| | B | 23 | 30 | 19.5 | 10 | | |
| | C | 22.5 | 23 | 20.5 | 17 | | |
| | average | 23.3 | | 20.0 | | | |

T2 seed selections of events generated by co-transformation of KS349 and KS362 were screened by GC analysis of seed chips as described above (Example 6). Seed were harvested from individual plants. Seed selections from heterozygous plants derived from transformations with *Yarrowia* DGAT genes segregated for elevated oleic acid content (>22% of total FA). Example 11 describes that event 4818.1.9 only contains an intact expression cassette for the DGAT1 gene from *Yarrowia*. Oil content of seed with elevated oleic acid content (with DGAT1 transgene) and null segregant seed from the same plant is shown in Table 17. In this table, oil content of seed containing the DGAT1 transgene was compared to that of non-transgenic null segregant plants from the same plant.

TABLE 17

Oil content of transgenic seed and null segregant seed derived from transgenic soybean T1 plants that segregate for a transgene with the *yarrowia* DGAT1 gene

| Event | PLANT | average oil (%) w transg. | n | average oil (%) null | n | Δ % points | Δ % |
|---|---|---|---|---|---|---|---|
| 4818.1.9 | A | 21.8 | 58 | 18.9 | 42 | 4.4 | 25.1 |
| | B | 21.3 | 16 | 17.0 | 6 | | |
| | C | 23.1 | 34 | 17.0 | 14 | | |
| | average | 22.1 | | 17.6 | | | |

Example 11 describes that other events generated by co-transformation of KS349 and KS362 contain an intact expression cassette for both DGAT genes of *Yarrowia*. Oil content of seed with elevated oleic acid content (with both DGAT transgenes) and null segregant seed from the same plant is shown in Table 18. In this table, oil content of seed containing both DGAT trangenes was compared to that of non-transgenic null segregant plants from the same plant.

TABLE 18

Oil content of transgenic seed and null segregant seed derived from transgenic soybean T1 plants that segregate for transgenes with DGAT1 and DGAT2 genes from yarrowia

| Event | PLANT | average oil (%) w transg. | n | average oil (%) null | n | Δ % points | Δ % |
|---|---|---|---|---|---|---|---|
| 4818.1.2 | A | 23.9 | 33 | 20 | 15 | 3.4 | 17.3 |
| | B | 22.9 | 35 | 20.3 | 13 | | |
| | C | 23 | 31 | 19.2 | 17 | | |
| | average | 23.3 | | 19.8 | | | |
| 4818.1.3 | A | 24.5 | 32 | 21.6 | 16 | 3.4 | 16.3 |
| | B | 23.6 | 34 | 19.5 | 14 | | |
| | C | 25.3 | 28 | 22 | 20 | | |
| | average | 24.5 | | 21.0 | | | |
| 4818.2.6 | A | 22.3 | 31 | 19 | 17 | 3.2 | 15.8 |
| | B | 24.1 | 21 | 20.6 | 27 | | |
| | C | 24.1 | 23 | 20.7 | 25 | | |
| | D | 23.2 | 30 | 20.6 | 18 | | |
| | average | 23.4 | | 20.2 | | | |

T2 seed selection homozygous for the KS362 derived *Yarrowia* DGAT2 expression cassette no longer segregated for the DS red marker. Oil content of 48 seed (or all available seed if less than 48 seed were available) was measured by NMR. For each event DS-red negative T1 seed were planted and T2 seed of null segregants were harvested from plants grown in the same growth chamber used for cultivation of T1 plants homozygous for the DGAT transgene. Oil content of seed derived form null segregant selections and lines homozygous for the DGAT transgene in shown in Table 19.

TABLE 19

Oil content of null segregant seed and transgenic seed derived from transgenic soybean T1 plants that are homozygous for transgenes with *yarrowia* DGAT2 gene

| EVENT | PLANT | n | average oil (%) | Δ % points | Δ % |
|---|---|---|---|---|---|
| 4822.1.13 | A | 48 | 22.7 | 2.3 | 11.6 |
| | B | 48 | 21.9 | | |
| | C | 48 | 22.7 | | |
| | average | | 22.4 | | |
| | NULL-A | 48 | 19.7 | | |
| | NULL-B | 48 | 20.5 | | |
| | average | | 20.1 | | |
| 4822.1.9 | A | 48 | 23.0 | 3.6 | 18.5 |
| | B | 48 | 24.0 | | |
| | C | 48 | 22.7 | | |
| | average | | 23.2 | | |
| | NULL-A | 48 | 19.6 | | |
| 4822.2.10 | A | 48 | 22.5 | 2.3 | 10.9 |
| | B | 48 | 24.4 | | |
| | average | | 23.5 | | |
| | NULL-A | 48 | 20.9 | | |
| | NULL-B | 48 | 21.4 | | |
| | average | | 21.2 | | |

T2 seed selection homozygous for KS349-derived *Yarrowia* DGAT1 and KS362-derived DGAT2 expression cassettes no longer segregated with respect to the elevated oleic acid phenotype (≧22% oleic) associated with expression of *yarrowia* DGAT genes. Oil content of 48 seed (or all available seed if less than 48 seed were available) was measured by NMR. For each event T1 null segregant seed that showed no elevation oleic acid of were planted and T2 seed of these null segregants were harvested from plants grown in the same growth chamber used for cultivation of T1 plants homozygous for the DGAT transgenes. Oil content of seed derived form null segregant selections and lines homozygous for the DGAT transgene in shown in Table 20

TABLE 20

Oil content of null segregant seed and transgenic seed derived from transgenic soybean T1 plants that are homozygous for transgenes with DGAT1 and DGAT2 genes from *yarrowia*

| EVENT | PLANT | n | average oil (%) | Δ % points | Δ % |
|---|---|---|---|---|---|
| 4818.1.2 | A | 35 | 23.9 | 3.8 | 18.5 |
| | B | 48 | 24.1 | | |
| | average | | 24.0 | | |
| | NULL-A | 48 | 20.1 | | |
| | NULL-B | 48 | 20.4 | | |
| | average | | 20.3 | | |
| 4818.1.3 | A | 48 | 24.4 | 4.5 | 22.8 |
| | B | 48 | 24.4 | | |
| | C | 48 | 24.3 | | |
| | average | | 24.4 | | |
| | NULL-A | 48 | 20.2 | | |
| | NULL-B | 48 | 19.5 | | |
| | average | | 19.9 | | |
| 4818.1.5 | A | 48 | 24.4 | 4.8 | 24.2 |
| | B | 13 | 24.4 | | |
| | C | 48 | 25.1 | | |
| | average | | 24.6 | | |
| | NULL-A | 48 | 19.4 | | |
| | NULL-B | 48 | 20.2 | | |
| | average | | 19.8 | | |
| 4818.2.6 | A | 46 | 24.2 | 3.1 | 14.4 |
| | NULL-A | 11 | 21.4 | | |
| | NULL-B | 48 | 20.9 | | |
| | average | | 21.2 | | |

In summary, growth chamber results show excellent heritability of the increased oil trait associated with overexpression of either a single *yarrowia* DGAT genes or co-expression of both *yarrowia* DGAT genes in soybean seed. Oil increase (compared to null segregant seed) associated with expression of a single *yarrowia* DGAT genes is at least 10.9% and as high as 25.1%. Oil increase (compared to null segregant seed) associated with expression of both *yarrowia* DGAT genes is at least 14.4% and as high as 24.2%.

Example 13A

Analysis of Transgenic Events: Field

The present example describes measurements of oil content of soybean derived from T2 plants that were homozygous or heterozygous for transgenes comprising YL DGAT1 or YL DGAT2 or both YL DGAT genes. T2 plants were grown in a non-controlled environment (field).

DS red positive T1 seed of transgenic events generated with YL DGAT2 (contained in KS 362) and corresponding DS red negative null segregant seed were grown in a field in Iowa in the summer of 2007. T1 seed with elevated oleic acid content that had been generated by co-transformation with YL DGAT1 and YL DGAT2 and corresponding null segregant seed with normal levels of oleic acid were grown in a similar fashion. T2 seed were harvested from individual plants and subjected to NMR analysis to measure oil content. Table 21 shows oil content of 48 uniformly DS red positive seed derived from events that were homozygous for the KS362 transgene and that of DS-red negative seed from null segregant seed of the same event grown in the same environment.

TABLE 21

Oil content null segregant seed and transgenic seed derived from field-grown transgenic soybean T1 plants that are homozygous for transgenes with the *yarrowia* DGAT2 gene

| EVENT | PLANT | n | average oil (%) | Δ % points | Δ % |
|---|---|---|---|---|---|
| 4822.1.2 | A | 48 | 22.4 | 2.4 | 13 |
| | B | 48 | 20.5 | | |
| | C | 48 | 21.5 | | |
| | E | 48 | 21.7 | | |
| | F | 48 | 20.7 | | |
| | G | 40 | 19.5 | | |
| | H | 16 | 23 | | |
| | average | | 21.3 | | |
| | Null A | 48 | 18.9 | | |
| | Null B | 48 | 19 | | |
| | Null C | 48 | 18.7 | | |
| | Null D | 16 | 17.9 | | |
| | Null E | 24 | 20.2 | | |
| | average | | 18.9 | | |
| 4822.2.11 | A | 48 | 22.1 | 2.6 | 14 |
| | B | 47 | 21 | | |
| | C | 48 | 23.8 | | |
| | D | 48 | 21.1 | | |
| | E | 48 | 23.1 | | |
| | F | 48 | 22 | | |
| | G | 48 | 20.4 | | |
| | H | 48 | 20.8 | | |
| | I | 48 | 20.3 | | |
| | average | | 21.6 | | |
| | Null A | 48 | 19.2 | | |
| | Null B | 48 | 19.5 | | |
| | Null C | 48 | 18.3 | | |
| | average | | 19.0 | | |
| 4822.2.10 | A | 40 | 21.8 | 2.6 | 13.6 |
| | B | 48 | 21.8 | | |
| | average | | 21.8 | | |
| | Null A | 48 | 18.6 | | |
| | Null B | 48 | 19.2 | | |
| | Null C | 48 | 19.2 | | |
| | Null E | 16 | 19.7 | | |
| | Null F | 48 | 19.7 | | |
| | Null G | 48 | 19 | | |
| | average | | 19.2 | | |

Table 22 shows oil content of 48 seed from segregants that were homozygous for YL DGAT1 and YL DGAT2 transgenes. All seed harvested from these homozygous T2 seed selections showed the elevated oleic acid content associated with YL DGAT expression. In Table 22 oil content of these lines is compared to that of null segregant seed of the same events with unaltered levels of oleic acid, derived from plants grown in the same environment.

TABLE 22

Oil content null segregant seed and transgenic seed derived from field-grown transgenic soybean T1 plants that are homozygous for transgenes with the *yarrowia* DGAT1 and DGAT2 genes.

| EVENT | PLANT | n | average oil (%) | Δ % points | Δ % |
|---|---|---|---|---|---|
| 4818.1.2 | A | 37 | 22.2 | 3.8 | 20 |
| | B | 48 | 22.5 | | |
| | C | 48 | 22.7 | | |
| | D | 48 | 22.6 | | |
| | E | 48 | 24.3 | | |
| | F | 40 | 21.5 | | |
| | average | | 22.6 | | |
| | Null A | 48 | 17.9 | | |
| | Null B | 48 | 18.9 | | |
| | Null C | 48 | 19.4 | | |
| | Null D | 48 | 19.5 | | |
| | Null E | 48 | 19.7 | | |
| | Null F | 48 | 18.4 | | |
| | Null G | 48 | 17.9 | | |
| | average | | 18.8 | | |
| 4818.1.3 | A | 48 | 23.5 | 3.5 | 19 |
| | B | 48 | 22.4 | | |
| | C | 48 | 22.8 | | |
| | D | 19 | 21.3 | | |
| | E | 48 | 20.5 | | |
| | F | 48 | 22.3 | | |
| | G | 48 | 22.8 | | |
| | H | 48 | 22.5 | | |
| | average | | 22.3 | | |
| | Null A | 48 | 18.4 | | |
| | Null B | 48 | 19.1 | | |
| | Null C | 48 | 17.9 | | |
| | Null D | 48 | 19 | | |
| | Null E | 48 | 19.3 | | |
| | Null F | 48 | 18.3 | | |
| | Null G | 48 | 18.3 | | |
| | average | | 18.6 | | |

Example 11 describes that event 4818.1.9 only contains an intact expression cassette for the DGAT1 gene from *Yarrowia*. Three T1 plants of this event derived from T1 seed with elevated oleic acid content were grown in the Iowa field along side null segregant plants derived from T1 seed with unaltered oleic acid content. T2 seed from all three transgenic segregants still showed segregation of the elevated oleic acid phenotype indicating that the parental lines were still heterozygous for the DGAT1 transgene. Using GC analysis all transgene-positive seed were identified from these lines and subjected to oil analysis by NMR. In Table 23 oil content of these seed is compared to that of null segregant seed derived from T1 plants gown in the same environment.

TABLE 23

Oil content null segregant seed and transgenic seed derived from field-grown transgenic soybean T1 plants that are heterozygous for transgenes with the *yarrowia* DGAT1 gene.

| EVENT | PLANT | n | average oil (%) | Δ % points | Δ % |
|---|---|---|---|---|---|
| 4818.1.9 | A | 14 | 20.7 | 2.0 | 11 |
| | B | 14 | 19.1 | | |
| | C | 20 | 20 | | |
| | average | | 20.0 | | |
| | Null A | 40 | 18.1 | | |
| | Null B | 40 | 17.8 | | |
| | average | | 18.0 | | |

In summary, field environment results show excellent heritability of the increased oil trait associated with overexpression of either a single *yarrowia* DGAT genes or co-expression of both *yarrowia* DGAT genes in soybean seed. Oil increase (compared to null segregant seed) associated with expression of a single *Yarrowia* DGAT genes is at least 11% and as high as 14%. Oil increase (compared to null segregant seed) associated with expression of both *yarrowia* DGAT genes is at least 19% and as high as 20%.

Example 13B

Compositional Analysis of Soybean Seed

The present example describes measurements of seed compositional parameters such as protein content and content of soluble carbohydrates of soybean seed derived from transgenic events that express single YL DGAT genes (YL DGAT2) of both YL DGAT genes.

Changes in the composition of soybean seed associated with expression of YL DGAT genes were measured. To this end the concentrations of protein, soluble carbohydrates and starch were measured as follows.

Non-Structural Carbohydrate and Protein Analysis.

Dry soybean seed were ground to a fine powder in a Geno-Grinder and subsamples were weighed (to an accuracy of 0.1 mg) into 13×100 mm glass tubes; the tubes had Teflon® lined screw-cap closures. Three replicates were prepared for each sample tested. Tissue dry weights were calculated by weighing sub-samples before and after drying in a forced air oven for 18 h at 105 C.

Lipid extraction was performed by adding 2 ml aliquots of heptane to each tube. The tubes were vortex mixed and placed into an ultrasonic bath (VWR Scientific Model 750D) filled with water heated to 60 C. The samples were sonicated at full-power (~360 W) for 15 min and were then centrifuged (5 min×1700 g). The supernatants were transferred to clean 13×100 mm glass tubes and the pellets were extracted 2 more times with heptane (2 ml, second extraction, 1 ml third extraction) with the supernatants from each extraction being pooled. After lipid extraction 1 ml acetone was added to the pellets and after vortex mixing, to fully disperse the material, they were taken to dryness in a Speedvac.

Non-Structural Carbohydrate Extraction and Analysis.

Two ml of 80% ethanol was added to the dried pellets from above. The samples were thoroughly vortex mixed until the plant material was fully dispersed in the solvent prior to sonication at 60 C for 15 min. After centrifugation, 5 min× 1700 g, the supernatants were decanted into clean 13×100 mm glass tubes. Two more extractions with 80% ethanol were performed and the supernatants from each were pooled. The extracted pellets were suspended in acetone and dried (as above). An internal standard β-phenyl glucopyranoside (100 ul of a 0.5000+/−0.0010 g/100 ml stock) was added to each extract prior to drying in a Speedvac. The extracts were maintained in a desiccator until further analysis.

The acetone dried powders from above were suspended in 0.9 ml MOPS (3-N[Morpholino]propane-sulfonic acid; 50 mM, 5 mM $CaCl_2$, pH 7.0) buffer containing 100 U of heat stable α-amylase (from *Bacillus licheniformis*; Sigma A-4551). Samples were placed in a heat block (90 C) for 75 min and were vortex mixed every 15 min. Samples were then allowed to cool to room temperature and 0.6 ml acetate buffer (285 mM, pH 4.5) containing 5 U amyloglucosidase (Roche 110 202 367 001) was added to each. Samples were incubated for 15-18 h at 55 C in a water bath fitted with a reciprocating shaker; standards of soluble potato starch (Sigma S-2630) were included to ensure that starch digestion went to completion.

Post-digestion the released carbohydrates were extracted prior to analysis. Absolute ethanol (6 ml) was added to each tube and after vortex mixing the samples were sonicated for 15 min at 60 C. Samples were centrifuged (5 min×1700 g) and the supernatants were decanted into clean 13×100 mm glass tubes. The pellets were extracted 2 more times with 3 ml of 80% ethanol and the resulting supernatants were pooled. Internal standard (100 ul β-phenyl glucopyranoside, as above) was added to each sample prior to drying in a Speedvac.

Sample Preparation and Analysis

The dried samples from the soluble and starch extractions described above were solubilized in anhydrous pyridine (Sigma-Aldrich P57506) containing 30 mg/ml of hydroxylamine HCl (Sigma-Aldrich 159417). Samples were placed on an orbital shaker (300 rpm) overnight and were then heated for 1 hr (75 C) with vigorous vortex mixing applied every 15 min. After cooling to room temperature 1 ml hexamethyldisilazane (Sigma-Aldrich H-4875) and 100 ul trifluoroacetic acid (Sigma-Aldrich T-6508) were added. The samples were vortex mixed and the precipitates were allowed to settle prior to transferring the supernatants to GC sample vials.

Samples were analyzed on an Agilent 6890 gas chromatograph fitted with a DB-17MS capillary column (15 m×0.32 mm×0.25 um film). Inlet and detector temperatures were both 275 C. After injection (2 ul, 20:1 split) the initial column temperature (150 C) was increased to 180 C at a rate 3 C/min and then at 25 C/min to a final temperature of 320 C. The final temperature was maintained for 10 min. The carrier gas was $H_2$ at a linear velocity of 51 cm/sec. Detection was by flame ionization. Data analysis was performed using Agilent ChemStation software. Each sugar was quantified relative to the internal standard and detector responses were applied for each individual carbohydrate (calculated from standards run with each set of samples). Final carbohydrate concentrations were expressed on a tissue dry weight basis.

Protein Analysis

Protein contents were estimated by combustion analysis on a Thermo Finnigan Flash 1112EA combustion analyzer. Samples, 4-8 mg, weighed to an accuracy of 0.001 mg on a Mettler-Toledo MX5 micro balance were used for analysis. Protein contents were calculated by multiplying % N, determined by the analyzer, by 6.25. Final protein contents were expressed on a % tissue dry weight basis.

TABLE 24

| Event | | | Pinitol | Sorbitol | Fructose | Glucose | Myo-Inositol | Sucrose | Raffinose | Stachyose | Total g/kg | Starch | Protein (% DW) |
|---|---|---|---|---|---|---|---|---|---|---|---|---|---|
| 4818.1.5 | NULL | Mean | 1.57 | 0.26 | 4.60 | 1.61 | 0.27 | 47.0 | 8.01 | 35.88 | 99.2 | 0.45 | 38.6 |
| | | SD | 0.03 | 0.02 | 0.18 | 0.27 | 0.01 | 1.6 | 0.15 | 0.72 | 2.0 | 0.03 | 0.3 |
| 4818.1.5 | TG | Mean | 1.31 | 0.24 | 2.67 | 0.79 | 0.31 | 21.2 | 5.08 | 32.60 | 64.2 | 0.03 | 43.4 |
| | | SD | 0.09 | 0.00 | 0.07 | 0.02 | 0.01 | 0.4 | 0.11 | 1.21 | 1.7 | 0.02 | 0.2 |

Compositional analysis of soybean seed derived from two T1 plants that were either a null segregant or homozygous for an YL DGAT1 YL DGAT2 transgene. The plants were grown in the same growth chamber environment. If not indicated otherwise values are reported as g/kg DW.

Construction of pKR1234 comprising YL DGAT2

The NotI fragment of KS362 (SEQ ID NO:52), containing the YL DGAT2, was cloned into the NotI fragment of pKR72 (SEQ ID NO:26; Example 4) to produce pKR1234 (SEQ ID NO:68).

TABLE 25

| Event | | | Pinitol | Sorbitol | Fructose | Glucose | Myo-Inositol | Sucrose | Raffinose | Stachyose | Total g/kg | Starch | Protein (% DW) |
|---|---|---|---|---|---|---|---|---|---|---|---|---|---|
| 4822.2.10 | NULL | Mean | 1.66 | 0.17 | 5.50 | 2.57 | 0.28 | 47.2 | 6.64 | 45.0 | 108.9 | 0.31 | 40.2 |
| | | SD | 0.12 | 0.04 | 1.76 | 0.87 | 0.09 | 0.2 | 0.68 | 1.6 | 3.1 | 0.05 | 0.7 |
| 4822.2.10 | TG | Mean | 2.02 | 0.19 | 5.02 | 1.72 | 0.33 | 32.7 | 6.91 | 41.4 | 90.3 | 0.31 | 40.8 |
| | | SD | 0.06 | 0.01 | 0.33 | 0.18 | 0.02 | 1.0 | 0.18 | 0.6 | 1.5 | 0.11 | 0.9 |

Compositional analysis of soybean seed derived from a T1 plant that was heterozygous for an YL DGAT2 transgene. The plant was grown in a growth chamber. YL DGAT transgenic seed and null segregant seed were selected based on DS red expression as a visible marker. Eight DS red positive and DS red-negative seed were combined and analyzed as described above. If not indicated otherwise values are reported as g/kg DW.

Construction of pKR1236 Comprising YL DGAT1 and DGAT2

The glycinin Gy1 promoter was PCR amplified from pZBL119 (which is described in PCT Publication No. WO 2004/071467 and the contents of which are hereby incorporated by reference) using primers oSGly-2 (SEQ ID NO:69) and oSGly-3 (SEQ ID NO:70). The resulting PCR fragment was subcloned into the intermediate cloning vector pCR-

TABLE 26

| Event | | | Pinitol | Sorbitol | Fructose | Glucose | Myo-Inositol | Sucrose | Raffinose | Stachyose | Total g/kg | Starch | Protein (% DW) |
|---|---|---|---|---|---|---|---|---|---|---|---|---|---|
| 4822.2.10 | NULL | Mean | 2.44 | 0.26 | 1.16 | 1.12 | 0.44 | 57.7 | 8.5 | 39.0 | 110.6 | 3.20 | 41.5 |
| | | SD | 0.05 | 0.01 | 0.05 | 0.02 | 0.00 | 0.7 | 0.4 | 0.5 | 1.3 | 0.55 | 0.5 |
| 4822.2.10 | TG | Mean | 1.89 | 0.35 | 0.82 | 0.67 | 0.32 | 29.7 | 5.5 | 31.7 | 70.9 | 1.00 | 46.1 |
| | | SD | 0.06 | 0.09 | 0.14 | 0.06 | 0.01 | 1.5 | 0.1 | 0.5 | 2.2 | 0.23 | 0.7 |
| 4818.1.2 | NULL | Mean | 1.79 | 0.51 | 1.17 | 1.12 | 0.37 | 49.8 | 6.1 | 42.0 | 102.8 | 0.51 | 44.5 |
| | | SD | 0.02 | 0.01 | 0.13 | 0.13 | 0.01 | 2.6 | 0.4 | 2.4 | 5.1 | 0.07 | 2.2 |
| 4818.1.2 | TG | Mean | 1.87 | 0.32 | 0.71 | 0.52 | 0.40 | 35.7 | 6.0 | 37.7 | 83.2 | 0.35 | 46.4 |
| | | SD | 0.05 | 0.02 | 0.05 | 0.01 | 0.02 | 0.8 | 0.2 | 1.5 | 2.5 | 0.08 | 0.2 |

Compositional analysis of soybean seed derived from T1 plants that were heterozygous for a YL DGAT2 or a YL DGAT1 YL DGAT2 transgene. The plants were grown in the field. YL DGAT transgenic seed and null segregant seed were selected based on DS red expression (4822.2.10) as a visible marker or elevated oleic acid content determined by GC analysis (4818.1.2). Eight transgene-positive and transgene-negative seed were combined and analyzed as described above. If not indicated otherwise values are reported as g/kg DW.

Tables 24-26 illustrate that expression one or two YL DGAT genes in different environments (growth chamber, field) is associated with a consistent shift in seed composition that is characterized by a reduction in soluble carbohydrates, namely a reduction in sucrose and to a smaller extent a reduction in stachyose. Most importantly there is no reduction in protein content observed when oil accumulation is increased through expression of YL DGAT genes.

Example 14

Measurements of DGAT Activity in Developing Seed and Somatic Embryos

The present example describes construction of soybean expression vectors comprising Yarrowia DGAT2 alone or Yarrowia DGAT2 and DGAT1, expression of these gene(s) in soybean seed or somatic embryos and DGAT enzyme activity in these tissues.

Script AMP SK(+) (Stratagene), according to the manufacturer's protocol, to produce plasmid pPSgly32 (SEQ ID NO:71).

The PstII/NotI fragment of plasmid pSGly32 (SEQ ID NO:71), containing the Gy1 promoter, was cloned into the PstI/NotI fragment from plasmid pKR142 (which is described in PCT Publication No. WO 2004/071467), containing the leguminA2 3' transcription termination region, an ampicillin resistance gene, and bacterial ori, to produce pKR264 (SEQ ID NO:72). Thus, vector pKR264 contains a NotI site flanked by the promoter for the glycinin Gy1 gene and the leguminA2 3' transcription termination region (Gy1/NotI/legA2 cassette).

The NcoI/XbaI fragment of KS349 (SEQ ID NO:48), containing Yarrowia DGAT1, was cloned into the NcoI/XbaI sites of pKR908, (US Pat. Pub US20080095915), which contains NcoI/XbaI sites flanked by NotI sites, to produce pKR1212 (SEQ ID NO:73).

The NotI fragment of pKR1212 (SEQ ID NO:73), containing the Yarrowia DGAT1 gene, was cloned into the NotI site of pKR264 (SEQ ID NO:72) to produce pKR1235 (SEQ ID NO:74).

The BsiWI fragment of pKR1235 (74), containing the Yarrowia DGAT1, gene was cloned into the BsiWI site of pKR1234 (SEQ ID NO:68) to produce pKR1236 (SEQ ID NO:75).

DGAT Assays on Microsomal Extracts from Developing T2 Seed

Soybean embryogenic suspension cultures (cv. Jack) were transformed with KS362 as described herein (Example 6), comprising *Yarrowia* DGAT2, as described herein and T1 seed from soy plants AFS4822.1.13.1 (seed called 7GR11-58) and AFS4822.2.10.1 (seed called 7GR11-66) were planted and plants grown as described in Example 12. In both of these events seed oil concentration of transgene positive seed was found to be elevated when compared to null segregant seed of the same event.

Similarly, soybean embryogenic suspension cultures (cv. Jack) were co-transformed with KS362 (comprising YL DGAT2) and KS349 (comprising YL DGAT1) as described herein (Example 6). Transgene-positive T1 seed from event AFS4818.1.2.1 are represented by seed 7GR11-2. In this event, seed oil concentration of transgene positive seed was found to be elevated when compared to null segregant seed of the same event (Example 6). Transgene-negative, null segregant T1 seed derived from AFS4818.1.2.1 and AFS4818.1.3.1 are represented by 7GR11-7 and 7GR11-15. These seed were planted and plants grown as described in Example 12.

Approximately 1 g of T2 seed were collected from selected plants 30 days after flowering (DAF) and were snap frozen in liquid nitrogen and stored at −80 C until ready to process.

coenzyme A (50 mCi/mmol, Perkin Elmer), 1.5 mM dioleoylglyceride (Sigma-Aldrich) and 20 μg of microsomal protein in a total reaction volume of 100 μl. Each reaction was initiated by addition of the microsomal membranes to the remainder of the reaction components. Assays were terminated by the addition of 1 mL of hot isopropanol (75 C) and heating at 75 for 10 min. Assays were cooled to RT, 1.5 mL of hexane was added and samples were mixed. Phases were separated by low speed centrifugation after addition of 1.25 ml of 500 mM sodium sulfate and the upper phase was transferred to another glass tube. The top phase was then dried under nitrogen gas. The lipid from each assay was re-dissolved in 75 uL of hexane spiked with 1 uL of soybean oil. Lipid was applied to a Partisil K6 Silica Gel 60 A TLC plate (Whatman, 250 um thickness, 20 cm×20 cm) and triglycerides were separated from other lipids by development with 80:20:1 (v/v/v) hexane:diethylether:acetic acid. Triacylglycerol was visualized and marked by light staining in iodine vapor in a tank. The plate was removed from the iodine tank and after the stain faded, the triacylglycerol was scraped, and radioactivity determined by liquid scintillation counting and expressed as dpm per min. Total activity was determined as the amount of radiolabeled oleic acid incorporated into triacylglycerol per minute per mg of protein using the following formula: ([dpm]/[2200000 dpm/uCi]/[50 uCi/umol]/[5 min.]/[0.02 mg protein]×[1000 nmol/umol]). DGAT activities for each of the samples described are shown in Table 27.

TABLE 27

DGAT activities for selected developing T2 seed.

| Exp. | Plasmid(s) | DGAT(s) | Event | T1 plant | T1 Seed | T1 Seed Oil Phenotype | T2 Developing Seed DGAT Activity (nmol · min-1 · mg-1) |
|---|---|---|---|---|---|---|---|
| 4818 | KS362 KS349 | DGAT2 DAGT1 | AFS4818.1.2 | AFS4818.1.2.1 | 7GR11-2 | DGAT | 2.8 |
| 4818 | KS362 KS349 | DGAT2 DAGT1 | AFS4818.1.2 | AFS4818.1.2.1 | 7GR11-7 | null | 0.4 |
| 4818 | KS362 KS349 | DGAT2 DAGT1 | AFS4818.1.3 | AFS4818.1.3.1 | 7GR11-15 | null | 0.4 |
| 4822 | KS362 | DGAT2 | AFS4822.1.13 | AFS4822.1.13.1 | 7GR11-58 | DGAT | 2.4 |
| 4822 | KS362 | DGAT2 | AFS4822.2.10 | AFS4822.2.10.1 | 7GR11-66 | DGAT | 1.6 |

After grinding 1 g of frozen seed tissue in liquid nitrogen in a mortar and pestle, 3 mL of plant homogenization buffer (300 mM sucrose; 1 mM EDTA; 10 mM Tris.HCl, pH 8.0; 1 mM DTT; 0.1% polyvinylpolypyrrolidine) was added and tissue was further homogenized using a polytron homogenizer for 1 minute. Debris was collected by vacuum filtration through 3 layers of cheese cloth followed by filtration through 1 layer of mira cloth. The resulting filtrate was centrifuged for 15 min. twice at 1,500×g and the resulting supernatant was then centrifuged at 100,000×g for 60 min. The resulting pellet was responded in approximately 0.5 to 1 mL of microsome buffer (100 mM potassium phosphate, pH 7.2) by gentle pipetting followed by further resuspension in a 2 mL sized Teflon-coated Dounce homogenizer. Protein concentrations were determine using Bradford reagent (Sigma-Aldrich) and microsomes were snap frozen in liquid nitrogen and stored at −80 C until assayed.

DGAT assays were carried out for 5 min at 25° C. in plant assay buffer (500 mM Tricine, pH 7.8; 28 mM sodium chloride; 0.06% CHAPS), with 20 μM 1-14C-labeled oleoyl- DGAT Assays on Microsomal Extracts from Soybean Somatic Embryos Soybean embryogenic suspension cultures (cv. Jack) were transformed with either pKR1234 (SEQ ID NO:68), comprising *Yarrowia* DGAT2 and having experiment number MSE2181, or with pKR1236 (SEQ ID NO:75), comprising *Yarrowia* DGAT2 and DGAT1 and having experiment number MSE2182. Events were selected and somatic embryos matured in SHaM as described in Example 5.

After 2 weeks of maturation in SHaM, approximately 1 g of tissue from each event was frozen in liquid nitrogen and tissue was ground with a mortar and pestle as described for soybean developing seed. A small amount of ground tissue (approximately 100 mg) was lyophilized overnight and the remaining tissue was stored at −80 C.

Oil concentrations were determined on approximately 10 mg of lyophilized tissue from each event using the GC method and 17:0 internal standard exactly as described in Example 5 and results for oil concentrations and oleic acid content (% of total FAME) are shown in Table 28. Microsomal protein preparations were made, protein concentrations determined and DGAT assays were carried out on selected events determined to have a range of oil concentrations exactly as previously described for seed tissue. Results for DGAT assays are also shown in Table 28.

TABLE 28

Esterified Fatty Acid, Oleic Acid Content and DGAT activities of Soybean Somatic Embryos Transformed with either pKR1234 or pKR1236

| Event # | FAME (% DCW) | oleic acid (% total FAME) | DGAT Activity (nmol · min−1 · mg−1) |
|---|---|---|---|
| MSE2181-pKR1234 (YL DGAT2) | | | |
| 8 | 8.9 | 31.9 | 3.6 |
| 5 | 7.3 | 33.8 | 4.5 |
| 3 | 6.6 | 32.6 | 2.5 |
| 9 | 6.2 | 30.7 | 2.5 |
| 7 | 6.1 | 30.4 | |
| 16 | 5.8 | 25.4 | 1.6 |
| 12 | 5.6 | 26.1 | |
| 15 | 5.4 | 26.7 | 2.8 |
| 4 | 4.6 | 22.5 | 0.7 |
| 11 | 4.2 | 22.7 | 0.5 |
| 14 | 4.0 | 21.2 | |
| 13 | 3.8 | 23.2 | 1.8 |
| 6 | 3.5 | 25.3 | |
| 10 | 3.2 | 21.2 | 0.5 |
| MSE2182-pKR1236 (YL DGAT2/YL DGAT1) | | | |
| 2 | 10.9 | 38.8 | 6.3 |
| 7 | 10.8 | 38.8 | |
| 4 | 10.3 | 38.4 | 5.1 |
| 3 | 10.0 | 38.0 | |
| 8 | 9.8 | 38.1 | 4.4 |
| 17 | 9.6 | 29.3 | |
| 10 | 8.6 | 33.3 | 5.7 |
| 28 | 8.2 | 36.3 | |
| 13 | 8.1 | 43.6 | |
| 5 | 8.0 | 25.4 | |
| 20 | 8.0 | 36.4 | |
| 12 | 7.7 | 29.3 | 4.8 |
| 26 | 7.6 | 30.5 | |
| 24 | 7.2 | 33.4 | |
| 9 | 6.3 | 20.4 | 0.7 |
| 29 | 6.3 | 29.8 | |
| 21 | 6.1 | 31.1 | |
| 19 | 5.7 | 32.5 | |
| 6 | 5.6 | 21.7 | 0.5 |
| 23 | 5.6 | 33.5 | |
| 16 | 5.4 | 26.3 | |
| 25 | 5.1 | 20.3 | |
| 14 | 5.1 | 26.2 | 0.9 |
| 1 | 5.0 | 24.9 | |
| 18 | 4.9 | 22.2 | |
| 30 | 4.5 | 17.0 | 0.4 |
| 27 | 3.7 | 19.7 | |
| 15 | 3.2 | 21.6 | |
| 11 | 2.9 | 16.6 | 2.5 |
| 22 | 2.8 | 20.7 | |

Events transformed with pKR1234 and having some of the highest oil concentrations had increases in DGAT activity of up to 9-fold compared with those events having wild-type levels of oil. Events transformed with pKR1236 and having some of the highest oil concentrations had increases in DGAT activity of up to 15.8-fold compared with those events having wild-type levels of oil.

Soybean embryogenic suspension culture (cv. Jack) was also transformed with KS364 (SEQ ID NO:63), comprising Yarrowia DGAT2 and DGAT1 (Experiment #MSE2134) and individual events were analyzed for fatty acid profile and oil concentration as described in Example 5. Based on this data, one event (Event 54) having high oleic acid (32.83% of total fatty acids) and oil concentrations (12.5% DCWt) and one event (Event 33) having wild-type levels of oleic acid (15.52% of total fatty acids) and oil concentrations (8.2% DCWt) were chosen for DGAT assays. Transformed embryogenic suspension culture from each event was bulked up in SB 196 media and embryos matured in SHaM as described in Example 5.

After 2 weeks of maturation in SHaM, approximately 1 g of tissue from each event was frozen in liquid nitrogen, microsomal protein preparations were made and DGAT assays were carried out on each event exactly as previously described and results are shown in Table 29. Total lipid was also extracted and oleic acid and oil concentrations were determined as described below and results are reported in Table 29.

TABLE 29

Esterified Fatty Acid, Oleic Acid Content and DGAT activities of Soybean Somatic Embryos Transformed with KS364 KS364 (DGAT2/DGAT1)

| Event # | FAME (% DCW) | oleic acid (% total FAME) | DGAT Activity (nmol · min−1 · mg−1) |
|---|---|---|---|
| 33 | 8.2 | 15.5 | 0.3 |
| 54 | 12.7 | 32.1 | 3.2 |

The event having the high oil concentration (Event 54) had increases in DGAT activity of 10.7-fold compared with the event having wild-type levels of oil (Event 33).

Example 15

Analysis of Lipid Fractions of Transgenic Seed and Somatic Embryos Expressing DGAT Genes Soy somatic embryos transformed with KS364 from an event with wild-type concentrations of oil and oleic acid (Event 33) and from an event with high concentrations of oil and oleic acid (Event 54) were lyophilized for 48 hr and tissue was ground using a genogrinder exactly as described in Example 5.

Total Lipid Extraction

Total lipid was extracted from each event by the method of Bligh, E. G. & Dyer, W. J. (Can. J. Biochem. Physiol. 37:911-917 (1959)) with some modifications. Briefly, approximately 100 mg of ground tissue from each event was added to a 16 mm×125 mm sized test-tube with a teflon-lined screw cap lid. A mixture of methanol:chloroform/2:1 (6 mL) was added and the sample was extracted with gentle mixing for 1 hr after which 2 mL of chloroform was added followed by continued mixing for 30 min. Afterwards, 3.6 mL of water was added, the tube was vortexed vigorously and phases were separated by centrifugation in a clinical centrifuge. The lower organic layer was gently removed to a second glass test tube and the upper aqueous layers were re-extracted with 2 mL of chloroform. Centrifugation was repeated and the lower organic phase was combined with the first organic phase. Samples were dried under a stream of nitrogen at 50 C, total lipid was estimated by weighing and lipid was dissolved in chloroform:methanol/6:1 to a concentration of approximately 10 mg/mL. FAME analysis was carried out on approximately 50 ug of each sample using the sulfuric acid/methanol procedure described herein (Example 4) and results are shown in Table 30.

Separation of Neutral and Polar Lipids

Sep-pak amino-propyl solid phase extraction columns (Waters; 6 cc columns, WAT054560) were equilibrated with 5 mL of methanol followed by 5 mL of methanol:chloroform/ 1:1 followed by 5 mL of chloroform. Approximately 5 mg of total lipid in chloroform:methanol/6:1 was added to each column, followed by 5×1 mL aliquots of chloroform to elute neutral lipids and all fractions were collected, combined and dried under a stream of nitrogen at 50 C. Polar lipids were then eluted from each column using 5×1 mL aliquots of methanol:chloroform/1:1 followed by 5×1 mL aliquots of methanol and all fractions were combined and dried under nitrogen. Neutral lipids were dissolved in approximately 1 mL of CHCl3:MeOH/6:1 and polar lipids were dissolved in approximately 200 uL of CHCl3:MeOH/6:1. FAME analysis was carried out on approximately 50 ug of neutral lipid using the sulfuric acid/methanol procedure described herein (Example 4) and results are shown in Table 30.

Separation of TAG, PC and PE by TLC

Approximately 100 uL of neutral lipid extract was loaded 2 cm from the bottom of a Partisil K6 Silica Gel 60 A TLC plate (Whatman, 250 um thickness, 20 cm×20 cm). Similarly, approximately 200 uL of the polar lipid fraction was loaded onto the same TLC plate. Standard solutions (10 mg/mL in chloroform:methanol/6:1) of TAG, PC and PE were also spotted onto the plates. TLC plates were developed in CHCl3: MeOH:AcOH/65:35:8 until solvent front was approximately half way up the plate. TLC plates were then air dried for 10 min and developed fully in 70:30:1 (v/v/v) hexane:diethyl-ether:acetic acid. Standards were visualized by light staining with iodine vapour and corresponding bands for TAG, PC and PE were cut out of the TLC plate. Silica gel containing each lipid species was derivatized directly with sulfuric acid/ methanol as described herein (Example 4) and results are shown in Table 30.

Fatty Acid Positional Analysis of TAG

Fatty acid profiles of the sn2 position of TAG were determined using porcine pancreatic lipase to remove acyl groups from the sn1 and sn3 position of TAG only, followed by transesterification of the resulting monoacylglyceride (MAG) produced. Approximately 5 mg of neutral lipid extract was suspended in 2 mL of 1 M Tris.HCl, pH 8.0 along with 0.2 mL of 2.2% calcium chloride and 0.5 mL of 0.05% Bile salts in a glass screw cap test tube. The lipid was incubated at 37 C for 5 min, 5 mg of porcine pancreatic lipase was added directly and the suspension was incubated with shaking at 37 C for 20 min. After incubation, the reaction was reaction was terminated with the addition of 1 mL of ethanol followed by 1 mL of 6 M HCl. After mixing, 2.5 mL of diethyl ether was added, phases were separated by centrifugation and the top organic layer was removed carefully. The diethyl ether extraction was repeated and the top diethyl ether phase was combined with the first. After drying over anhydrous sodium sulfate, the diethyl ether was evaporated under a stream of nitrogen at 50 C and the resulting lipid was dissolved in 200 uL of chloroform:methanol/6:1. The lipid was loaded onto a Partisil K6 TLC plate along with triacylglyceride (TAG), diacylglyceride (DAG), monoacylglyceride (MAG) and free fatty acid (FFA) standards and the TLC plate was developed as described herein. Afterwards, standards were visualized with light iodine staining and the MAG band was cut and derivatized with methanol/sulfuric acid as previously described herein. Results for the fatty acid profile of FAME from the MAG band, representing the fatty acid profile of the sn2 position of TAG (i.e. the acyl group on C2 of glycerol), along with the calculated sn1 and sn3 positions, is shown in Table 30. In Table 30, the % of total fatty acid for each fatty acid (i.e. 16:0, 18:0, 18:1, 18:2, 18:3) at the sn1 and sn3 positions of TAG is calculated with the following formula: $=([TAGx]-[sn2x]/3)*3/2$; where the x indicates the fatty acid of interest.

TABLE 30

Fatty acid composition of various lipid species and positional distribution in TAG

| Sample | Event | % Oil | 16:0 | 18:0 | 18:1 | 18:2 | 18:3 |
|---|---|---|---|---|---|---|---|
| Total | 33 | 8.2 | 15.6 | 3.9 | 15.5 | 50.8 | 14.2 |
| Extract | 54 | 12.7 | 10.5 | 4.7 | 32.1 | 43.9 | 8.8 |
| Neutral | 33 | 8.2 | 14.4 | 3.7 | 17.0 | 52.5 | 12.4 |
| lipids | 54 | 12.7 | 9.8 | 5.3 | 36.0 | 42.3 | 6.6 |
| TAG | 33 | 8.2 | 18.2 | 4.8 | 20.8 | 47.4 | 8.7 |
|  | 54 | 12.7 | 11.8 | 5.8 | 40.7 | 37.0 | 4.6 |
| PC | 33 | 8.2 | 34.1 | 10.6 | 17.2 | 33.8 | 4.3 |
|  | 54 | 12.7 | 21.5 | 10.0 | 32.1 | 33.7 | 2.7 |
| PE | 33 | 8.2 | 41.1 | 6.8 | 13.4 | 25.9 | 12.8 |
|  | 54 | 12.7 | 45.8 | 9.8 | 21.9 | 15.3 | 7.1 |
| TAG-sn1 | 33 | 8.2 | 1.0 | 0.3 | 14.9 | 72.7 | 11.0 |
|  | 54 | 12.7 | 1.0 | 0.5 | 24.0 | 67.1 | 7.4 |
| TAG-sn1,3 | 33 | 8.2 | 26.8 | 7.0 | 23.8 | 34.9 | 7.5 |
| (Calculated) | 54 | 12.7 | 17.3 | 8.5 | 49.1 | 22.0 | 3.2 |

Changes in fatty acid profiles associated with YL DGAT expression observed in TAG are also observed in polar lipids.

Example 16

Yarrowia DGAT Variants with Altered Amino Acid Sequence

The present example describes the creation of mutant forms of Yarrowia DGAT2, cloning them into a yeast expression vector and assaying microsomal protein fractions for DGAT activity.

Constructing Saccharomyces Expression Vectors Containing Mutant Yarrowia DGAT2s

Yarrowia DGAT2 was amplified from pKR1234 (SEQ ID NO:68; Example 14) with oligonucleotide primers oYDG2-1 (SEQ ID NO:76) and oYDG2-2 (SEQ ID NO:77), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1254 (SEQ ID NO:78).

A single codon in the Yarrowia DGAT2 sequence, which codes for amino acid Y326 in the corresponding amino acid sequence SEQ ID NO:10, was changed using the Quickchange® Site Directed Mutagenesis kit (Cat. No. 200518, Stratagene, La Jolla, Calif.), with oligonucleotides YID2_Y326F-5 (SEQ ID NO:79) and YID2_Y326F-3 (SEQ ID NO:80), following the manufacturer's protocol. After extensive sequencing, a clone coding for an amino acid sequence which is identical to the Yarrowia DGAT2 (SEQ ID NO:10), except that Y326 was changed to F326, was chosen for further study. This clone was designated pKR1254_Y326F (SEQ ID NO:81). The nucleotide sequence for altered coding sequence (YIDGAT2_Y326F) is set forth in SEQ ID NO:82 and the corresponding amino acid sequence is set forth in SEQ ID NO:83.

A single codon in the Yarrowia DGAT2 sequence, which codes for amino acid Y326 in the corresponding amino acid sequence SEQ ID NO:10, was changed using the Quickchange® Site Directed Mutagenesis kit (Cat. No. 200518, Stratagene, La Jolla, Calif.), with oligonucleotides YID2_Y326L-5 (SEQ ID NO:84) and YID2_Y326L-3 (SEQ ID NO:85), following the manufacturer's protocol. After extensive sequencing, a clone coding for an amino acid sequence which is identical to the *Yarrowia* DGAT2 (SEQ ID NO:10), except that Y326 was changed to L326, was chosen for further study. This clone was designated pKR1254_Y326L (SEQ ID NO:86). The nucleotide sequence for altered coding sequence (YIDGAT2_Y326L) is set forth in SEQ ID NO:87 and the corresponding amino acid sequence is set forth in SEQ ID NO:88.

A single codon in the *Yarrowia* DGAT2 sequence, which codes for amino acid R327 in the corresponding amino acid sequence SEQ ID NO:10, was changed using the Quickchange® Site Directed Mutagenesis kit (Cat. No. 200518, Stratagene, La Jolla, Calif.), with oligonucleotides YID2_R327K-5 (SEQ ID NO:89) and YID2_R327K-3 (SEQ ID NO:90), following the manufacturer's protocol. After extensive sequencing, a clone coding for an amino acid sequence which is identical to the *Yarrowia* DGAT2 (SEQ ID NO:10), except that R327 was changed to K327, was chosen for further study. This clone was designated pKR1254_R327K (SEQ ID NO:91). The nucleotide sequence for altered coding sequence (YIDGAT2_Y326L) is set forth in SEQ ID NO:92 and the corresponding amino acid sequence is set forth in SEQ ID NO:93.

The NotI fragments of pKR1254, pKR1254_Y326F, pKR1254_Y326L or pKR1254_R327K, each containing a wild-type or mutant version of YIDGAT2, were cloned into the NotI site of pY75 (SEQ ID NO:3; Example 1) to produce pY191 (SEQ ID NO:94), pY192 (SEQ ID NO:95), pY193 (SEQ ID NO:96) or pY194 (SEQ ID NO:97), respectively.

Assaying DGAT Activity of Mutant *Yarrowia* DGAT2s

A mutant strain of *Saccharomyces cerevisiae* where the endogenous DGAT2 gene (DGA1) was knocked out and has the following genotype (BY4741, MATa his3Δ1 leu2Δ0 met15Δ0 ura3Δ0) was obtained from Open Biosystems (www.openbiosystems.com/). It was transformed with pY191, pY192, pY193 or pY194 and transformants were isolated as described herein. Three individual transformants per transformation were inoculated into 2 mL cultures of DOBA media supplemented with CSM-leu 30° C. for 16 h. Cells (1 mL) were transferred to 50 mL of DOBA medium described above and grown at 30° C. for an additional 16 h. Cells were pelleted by centrifugation, frozen in liquid nitrogen and stored at −80° C. until required for use.

Pellets were re-suspended in 2 mL of yeast homogenization buffer (20 mM Tris.HCl, pH 8.0; 10 mM MgCl2; 1 mM EDTA; 5% glycerol; 1 mM DTT; 0.3 M $(NH_4)_2SO_4$) and the suspension was added to a 2 mL screw cap tube containing approximately 1 mL of 0.5 mm glass beads. The after removal of air pockets by vortexing, the resuspension was filled to the top of the tube, the tube capped and the cells broken with three, 1 min. pulses in a mini bead beater at 5000 rpm with storage on ice for 5 min. The yeast homogenate was centrifuged at 1,500×g for 15 min. at 4 C and the resulting supernatant was then centrifuged at 100,000×g for 60 min. The resulting pellet was responded in approximately 0.2 to 0.5 mL of microsome buffer (100 mM potassium phosphate, pH 7.2) by gentle pipetting followed by further resuspension in a 2 mL sized Teflon-coated Dounce homogenizer. Protein concentrations were determine using Bradford reagent (Sigma-Aldrich) and microsomes were snap frozen in liquid nitrogen and stored at −80 C until assayed.

DGAT assays were carried out for 1 min at 25° C. in yeast assay buffer (50 mM potassium phosphate (pH 7.2)), with 20 µM 1-14C-labeled oleoyl-coenzyme A (50 mCi/mmol, PerkinElmer), and 20 µg of microsomal protein in a total reaction volume of 100 µl. Each reaction was initiated by addition of the microsomal membranes to the remainder of the reaction components. Assays were terminated and radioactivity into TAG determined exactly as described for the plant DGAT assays except the formula was changed to reflect a 1 min. assay time (i.e. [dpm]/[2200000 dpm/uCi]/[50 uCi/umol]/[5 min.]/[0.02 mg protein]×[1000 nmol/umol]).

DGAT activities for each of the samples as well as the averages described are shown in Table 31.

TABLE 31

| | | DGAT activities for DGA1 Transformed with pY191, pY192, pY193 or pY194. | | |
|---|---|---|---|---|
| Plasmid | Mutant | DGAT Activity (nmol · min$^{-1}$ · mg$^{-1}$) | Avg. DGAT Activity (nmol · min$^{-1}$ · mg$^{-1}$) | Std. Dev. |
| pY191 | wt | 7.6 | 10.4 | 2.7 |
| | | 10.6 | | |
| | | 13.0 | | |
| pY192 | Y326F | 6.5 | 8.3 | 1.7 |
| | | 8.4 | | |
| | | 10.0 | | |
| pY193 | Y326L | 6.2 | 8.1 | 1.9 |
| | | 10.0 | | |
| | | 8.2 | | |
| pY194 | R327K | 5.9 | 6.2 | 0.4 |
| | | 6.0 | | |
| | | 6.7 | | |

From Table 31, it appears that the Y326F and Y326L amino acid changes have minimal effect on *Yarrowia* DGAT2 activity when assayed in yeast and these two mutants were chosen for expression in soy somatic embryos.

Constructing Soy Expression Vectors Containing Mutant *Yarrowia* DGAT2s

The NotI fragment of pKR1254 (SEQ ID NO:78), pKR1254_Y326F (SEQ ID NO:81) or pKR1254_Y326L (SEQ ID NO:86), containing wild-type or mutant forms of *Yarrowia* DGAT2, were cloned into the NotI fragment of pKR72 (SEQ ID NO:26; Example 4) to produce pKR1256 (SEQ ID NO:98), pKR1277 (SEQ ID NO:99) or pKR1278 (SEQ ID NO:100), respectively.

Determining Oil Concentrations of Soy Somatic Embryos expressing Mutant *Yarrowia* DGAT2s Soybean embryogenic suspension culture (cv. Jack) was transformed with either pKR1256 (SEQ ID NO:98), comprising wild-type *Yarrowia* DGAT2 and having experiment number MSE2228, pKR1277 (SEQ ID NO:99), comprising *Yarrowia* DGAT2_Y326F and having experiment number MSE2229, or pKR1278 (SEQ ID NO:100), comprising *Yarrowia* DGAT2_Y326L and having experiment number MSE2230. Events were selected and somatic embryos matured in SHaM as described in Example 5. Oil concentrations were determined for each event using the NMR and described herein and fatty acid profiles were determined by GC exactly as described in herein and results for oil concentrations and oleic acid content (% of total FAME) are shown in Table 32

TABLE 32

Oil concentrations for somatic soy embryos transformed with pKR1256, pKR1277 or pKR1278

| Event # | FAME (% DCW) | oleic acid (% total FAME) |
|---|---|---|
| MSE2228-pKR1256 (wt DGAT2) | | |
| 2228-9 | 14.3 | 44.4 |
| 2228-20 | 12.6 | 34.3 |
| 2228-3 | 12.4 | 39.3 |
| 2228-14 | 12.3 | 36.8 |
| 2228-2 | 11.7 | 36.8 |
| 2228-15 | 10.9 | 35.2 |
| 2228-5 | 10.1 | 23.3 |
| 2228-17 | 10.0 | 23.5 |
| 2228-24 | 10.0 | 27.6 |
| 2228-6 | 9.5 | 25.2 |
| 2228-18 | 9.5 | 32.4 |
| 2228-21 | 9.0 | 32.9 |
| 2228-12 | 8.7 | 22.7 |
| 2228-10 | 8.4 | 24.3 |
| 2228-22 | 7.5 | 29.9 |
| 2228-8 | 6.8 | 21.4 |
| 2228-19 | 6.5 | 27.3 |
| 2228-23 | 6.4 | 26.5 |
| 2228-7 | 6.1 | 22.2 |
| 2228-13 | 6.1 | 24.0 |
| 2228-11 | 5.2 | 24.3 |
| 2228-4 | 5.1 | 18.5 |
| 2228-16 | 4.2 | 19.3 |
| 2228-1 | 3.2 | 23.1 |
| average | 8.6 | 28.1 |
| MSE2229-pKR1277 (Y326F) | | |
| 2229-6 | 15.1 | 43.5 |
| 2229-20 | 14.4 | 44.3 |
| 2229-13 | 14.4 | 38.1 |
| 2229-21 | 14.0 | 36.5 |
| 2229-16 | 13.2 | 36.3 |
| 2229-24 | 13.1 | 39.9 |
| 2229-23 | 12.3 | 42.7 |
| 2229-3 | 12.2 | 41.3 |
| 2229-25 | 12.0 | 40.4 |
| 2229-31 | 11.9 | 39.0 |
| 2229-18 | 11.6 | 40.8 |
| 2229-5 | 11.4 | 38.7 |
| 2229-12 | 11.3 | 36.7 |
| 2229-10 | 11.3 | 35.6 |
| 2229-27 | 10.9 | 27.8 |
| 2229-30 | 10.7 | 39.0 |
| 2229-15 | 10.4 | 36.3 |
| 2229-8 | 9.7 | 39.5 |
| 2229-9 | 9.4 | 37.4 |
| 2229-22 | 9.2 | 22.3 |
| 2229-7 | 8.7 | 23.0 |
| 2229-26 | 8.4 | 31.2 |
| 2229-17 | 8.3 | 38.2 |
| 2229-28 | 7.9 | 27.2 |
| 2229-29 | 7.8 | 25.7 |
| 2229-1 | 7.4 | 32.8 |
| 2229-2 | 5.9 | 18.6 |
| 2229-11 | 4.6 | 18.6 |
| 2229-19 | 4.1 | 22.6 |
| 2229-4 | 4.0 | 21.2 |
| 2229-14 | 3.1 | 39.8 |
| average | 8.8 | 32.2 |
| MSE2230-pKR1278 (Y326L) | | |
| 2230-4 | 11.6 | 35.1 |
| 2230-21 | 10.1 | 22.3 |
| 2230-15 | 9.8 | 22.4 |
| 2230-8 | 9.7 | 34.9 |
| 2230-29 | 9.6 | 33.0 |
| 2230-27 | 9.4 | 35.6 |
| 2230-3 | 9.4 | 36.7 |
| 2230-19 | 9.0 | 34.7 |
| 2230-6 | 8.6 | 23.6 |
| 2230-24 | 8.5 | 23.3 |
| 2230-18 | 8.4 | 35.8 |
| 2230-22 | 7.3 | 23.3 |
| 2230-2 | 7.0 | 26.7 |
| 2230-14 | 6.9 | 25.9 |
| 2230-9 | 6.9 | 22.9 |
| 2230-25 | 6.8 | 27.3 |
| 2230-7 | 6.8 | 37.5 |
| 2230-5 | 6.5 | 25.6 |
| 2230-10 | 6.4 | 31.1 |
| 2230-30 | 6.3 | 24.7 |
| 2230-26 | 6.3 | 23.4 |
| 2230-17 | 6.3 | 25.2 |
| 2230-20 | 6.3 | 19.5 |
| 2230-13 | 5.8 | 22.3 |
| 2230-12 | 5.7 | 21.7 |
| 2230-23 | 5.6 | 25.1 |
| 2230-11 | 5.5 | 20.7 |
| 2230-1 | 5.4 | 26.3 |
| 2230-16 | 5.3 | 24.0 |
| 2230-28 | 4.6 | 20.4 |
| 2230-31 | 4.3 | 18.3 |
| average | 6.5 | 25.4 |

In soy somatic embryos, a variant of the YL DGAT2 protein carrying the Y326F mutation increases oil concentrations and shifts the fatty acid profile of the oil at least to the same extent as the wild-type *Yarrowia* DGAT2.

Example 17

Expression Optimized DGAT Genes

Sequences encoding YL DGAT1 and YL DGAT2 genes that are optimized for expression in soybean plants are set forth as SEQ ID NO:64 and SEQ ID NO:66. The design of these sequences is described in Example 9. DNA molecules with this DNA sequence flanked by Not I restriction sites were synthesized by DNA 2.0 (California, USA). Plasmid DNA with the synthesized genes was digested with Not I. Not I restriction fragments with the DGAT genes were ligated to Not linearized, dephosphorylated DNA of KS332, which is described in Example 5. The resulting DNA constructs in which expression of expression-optimized variants of *yarrowia* DGAT1 or *yarrowia* DGAT2 genes are under the control of the betaconglycinin promoter are henceforth referred to as KS392 and KS393. Their sequence is set forth as SEQ ID NO:101 and SEQ ID NO:102. Moreover plasmid KS391 was constructed. To this end DNA of KS349 was digested with NotI and NcoI. Ends of the of the resulting DGAT1 restriction fragment were completely filled-in and ligated to NotI linearized and filled in DNA of KS332. The resulting plasmid construct is henceforth referred to as KS391. In this construct the native YL DGAT1 sequences is under the control of the betaconglycinin promoter. The sequence of KS391 is set forth as SEQ ID NO:103. Transgenic soybean somatic embryos were regenerated as after particle bombardment with plasmid DNA of KS391, KS392, KS 362 and KS393 as described above (Example 5). Oil content of somatic embryos was measured using NMR. Briefly lyophilized embryo tissue was pulverized in genogrnder vial as described previously (Example 4). 20-200 mg of tissue powder were transferred to NMR tubes. Oil content of the somatic embryo tissue powder was calculated from the NMR signal as described in Example 4.

15.7% compared to 12.8% for KS391. Applicants have demonstrated that expression optimization of YL DGAT1 leads to increased oil content in developing soybean embryos when compared to the native YL DGAT1 gene.

TABLE 33

Oil content of soybean somatic embryos transformed with pKS392 and pKS391

|   | ID | CONSTRUCT | % oil |
|---|---|---|---|
| 1 | 2196.1.08 | KS392 | 15.7 |
| 2 | 2196.3.03 | KS392 | 13.9 |
| 3 | 2196.1.05 | KS392 | 13.7 |
| 4 | 2196.1.15 | KS392 | 13.4 |
| 5 | 2196.1.02 | KS392 | 12.2 |
| 6 | 2196.3.07 | KS392 | 12.1 |
| 7 | 2196.3.04 | KS392 | 12.1 |
| 8 | 2196.3.05 | KS392 | 11.6 |
| 9 | 2196.1.06 | KS392 | 11.4 |
| 10 | 2196.1.07 | KS392 | 11.4 |
| 11 | 2196.1.03 | KS392 | 10.4 |
| 12 | 2196.1.14 | KS392 | 10.2 |
| 13 | 2196.1.12 | KS392 | 9.4 |
| 14 | 2196.3.08 | KS392 | 9.1 |
| 15 | 2196.3.09 | KS392 | 8.1 |
| 16 | 2196.4.02 | KS392 | 8.1 |
| 17 | 2196.1.09 | KS392 | 7.8 |
| 18 | 2196.2.01 | KS392 | 7.6 |
| 19 | 2196.5.01 | KS392 | 7.4 |
| 20 | 2196.3.01 | KS392 | 7.4 |
| 21 | 2196.1.04 | KS392 | 7.3 |
| 22 | 2196.2.02 | KS392 | 7.3 |
| 23 | 2196.3.02 | KS392 | 6.9 |
| 24 | 2196.1.10 | KS392 | 6.5 |
| 25 | 2196.4.03 | KS392 | 6.5 |
| 26 | 2196.1.11 | KS392 | 6.0 |
| 27 | 2196.4.01 | KS392 | 5.7 |
| 28 | 2196.3.06 | KS392 | 5.4 |
| 29 | 2196.5.02 | KS392 | 5.3 |
| 30 | 2196.1.13 | KS392 | 3.5 |
|   | AVERAGE % OIL |  | 9.1 |
| 1 | 2195.3.15 | KS391 | 12.8 |
| 2 | 2195.5.02 | KS391 | 11.5 |
| 3 | 2195.3.01 | KS391 | 11.2 |
| 4 | 2195.3.03 | KS391 | 11.0 |
| 5 | 2195.3.02 | KS391 | 10.6 |
| 6 | 2195.4.06 | KS391 | 10.4 |
| 7 | 2195.3.08 | KS391 | 10.2 |
| 8 | 2195.2.01 | KS391 | 10.1 |
| 9 | 2195.3.04 | KS391 | 9.3 |
| 10 | 2195.3.05 | KS391 | 9.2 |
| 11 | 2195.5.01 | KS391 | 9.1 |
| 12 | 2195.2.04 | KS391 | 8.8 |
| 13 | 2195.3.14 | KS391 | 8.6 |
| 14 | 2195.3.10 | KS391 | 7.8 |
| 15 | 2195.4.01 | KS391 | 7.7 |
| 16 | 2195.5.03 | KS391 | 6.5 |
| 17 | 2195.4.02 | KS391 | 6.4 |
| 18 | 2195.3.09 | KS391 | 6.3 |
| 19 | 2195.4.07 | KS391 | 6.2 |
| 20 | 2195.3.06 | KS391 | 6.1 |
| 21 | 2195.3.13 | KS391 | 6.0 |
| 22 | 2195.5.05 | KS391 | 5.9 |
| 23 | 2195.4.03 | KS391 | 5.6 |
| 24 | 2195.5.04 | KS391 | 5.5 |
| 25 | 2196.1.01 | KS391 | 5.3 |
| 26 | 2195.4.04 | KS391 | 5.3 |
| 27 | 2195.3.11 | KS391 | 5.2 |
| 28 | 2195.2.03 | KS391 | 5.0 |
| 29 | 2195.4.05 | KS391 | 4.9 |
| 30 | 2195.3.07 | KS391 | 4.4 |
| 31 | 2195.2.02 | KS391 | 4.3 |
|   | AVERAGE % OIL |  | 7.6 |

Table 33 compares the oil content of 30 and 31 events generated with KS392 and KS 391, respectively. Average oil content of all events generated with KS392 was 9.1% whereas oil content of all events generated with KS391 was 7.6%. More over the highest oil content observed with KS392 was

TABLE 34

Oil content of soybean somatic embryos transformed with pKS393 and pKS362

| SAMPLE# | ID | CONSTRUCT | % oil |
|---|---|---|---|
| 1 | 2207.5.05 | KS393 | 12.3 |
| 2 | 2207.5.08 | KS393 | 12.2 |
| 3 | 2207.5.06 | KS393 | 11.7 |
| 4 | 2207.5.03 | KS393 | 10.8 |
| 5 | 2207.5.01 | KS393 | 10.6 |
| 6 | 2207.4.04 | KS393 | 10.3 |
| 7 | 2207.4.04 | KS393 | 10.3 |
| 8 | 2207.3.09 | KS393 | 9.5 |
| 9 | 2207.5.07 | KS393 | 9.3 |
| 10 | 2207.4.01 | KS393 | 8.8 |
| 11 | 2207.4.02 | KS393 | 8.7 |
| 12 | 2207.3.06 | KS393 | 8.0 |
| 13 | 2207.3.04 | KS393 | 7.9 |
| 14 | 2207.4.04 | KS393 | 7.8 |
| 15 | 2207.4.03 | KS393 | 7.7 |
| 16 | 2207.4.08 | KS393 | 7.4 |
| 17 | 2207.3.14 | KS393 | 7.1 |
| 18 | 2207.4.05 | KS393 | 7.0 |
| 19 | 2207.3.12 | KS393 | 7.0 |
| 20 | 2207.3.01 | KS393 | 6.9 |
| 21 | 2207.5.02 | KS393 | 6.8 |
| 22 | 2207.3.02 | KS393 | 6.7 |
| 23 | 2207.3.07 | KS393 | 6.7 |
| 24 | 2207.3.03 | KS393 | 6.6 |
| 25 | 2207.3.13 | KS393 | 6.5 |
| 26 | 2207.3.11 | KS393 | 6.3 |
| 27 | 2207.3.05 | KS393 | 5.8 |
| 28 | 2207.3.10 | KS393 | 5.8 |
| 29 | 2207.4.07 | KS393 | 5.5 |
| 30 | 2207.3.08 | KS393 | 5.4 |
| 31 | 2207.4.09 | KS393 | 5.4 |
|   | AVERAGE % OIL |  | 8.0 |
| 1 | 2208.2.08 | KS362 | 11.6 |
| 2 | 2208.5.04 | KS362 | 11.5 |
| 3 | 2208.2.04 | KS362 | 11.5 |
| 4 | 2208.2.10 | KS362 | 11.2 |
| 5 | 2208.2.09 | KS362 | 10.3 |
| 6 | 2208.2.02 | KS362 | 10.2 |
| 7 | 2208.5.02 | KS362 | 10.0 |
| 8 | 2208.3.10 | KS362 | 9.8 |
| 9 | 2208.3.12 | KS362 | 9.8 |
| 10 | 2208.3.06 | KS362 | 9.5 |
| 11 | 2208.3.04 | KS362 | 8.8 |
| 12 | 2208.5.05 | KS362 | 8.6 |
| 13 | 2208.2.07 | KS362 | 8.1 |
| 14 | 2208.2.03 | KS362 | 8.0 |
| 15 | 2208.3.03 | KS362 | 8.0 |
| 16 | 2208.5.01 | KS362 | 8.0 |
| 17 | 2208.2.06 | KS362 | 7.8 |
| 18 | 2208.2.11 | KS362 | 7.4 |
| 19 | 2208.5.07 | KS362 | 7.3 |
| 20 | 2208.3.14 | KS362 | 7.2 |
| 21 | 2208.3.02 | KS362 | 7.0 |
| 22 | 2208.3.08 | KS362 | 6.4 |
| 23 | 2208.3.07 | KS362 | 6.1 |
| 24 | 2208.2.12 | KS362 | 6.1 |
| 25 | 2208.3.09 | KS362 | 6.0 |
| 26 | 2208.3.11 | KS362 | 6.0 |
| 27 | 2208.2.01 | KS362 | 5.8 |
| 28 | 2208.2.05 | KS362 | 5.7 |
| 29 | 2208.3.01 | KS362 | 5.4 |
| 30 | 2208.5.03 | KS362 | 5.1 |
| 31 | 2208.3.13 | KS362 | 4.7 |
| 32 | 2208.5.06 | KS362 | 4.1 |
| 33 | 2208.3.05 | KS362 | 3.2 |
|   | AVERAGE % OIL |  | 7.8 |

Table 34 compares the oil content of 31 and 33 events generated with KS393 and KS362. Average oil content of all events generated with KS393 was 8.0% whereas oil content of all events generated with KS393 was 7.8%. More over the highest oil content observed with KS393 was 12.3% compared to 11.6% for KS362. Applicants have demonstrated that expression optimization of YL DGAT2 leads a very small increase in oil content in developing soybean embryos when compared to the native YL DGAT2 gene.

Example 18

Co-Expression of YL DGAT1 with a FAD2/TE2 Down Regulation Construct in Soybean Somatic Embryos The present example describes construction of soybean expression vectors pKR1274, comprising *Yarrowia* DGAT1 (YL DGAT1) and either pKR1267 or pKR1269, comprising a soybean fatty acid desaturase 2 (GM FAD2)/thioesterase 2 (GM TE2) down-regulation construct. While the GM FAD2-TE2 down-regulation regions of pKR1267 and pKR1269 are identical in each construct and both are driven by the KTi3 promoter, pKR1267 contains only the KTi3 terminator and pKR1269 contains both the KTi3 and soy albumin terminators.

Construction of pKR1274 Comprising YL DGAT1

A starting plasmid pKR85 (SEQ ID NO:27), which was previously described in Example 4 contains the hygromycin B phosphotransferase gene (HPT) (Gritz, L. and Davies, J., *Gene* 25:179-188 (1983)), flanked by the T7 promoter and transcription terminator (T7prom/hpt/T7term cassette), and a bacterial origin of replication (ori) for selection and replication in bacteria (e.g., *E. coli*). In addition, pKR72 also contains the hygromycin B phosphotransferase gene, flanked by the 35S promoter (Odell et al., *Nature* 313:810-812 (1985)) and NOS 3' transcription terminator (Depicker et al., *J. Mol. Appl. Genet.* 1:561-570 (1982)) (35S/hpt/NOS3' cassette) for selection in plants such as soybean. Plasmid pKR85 (SEQ ID NO:27) also contains a NotI restriction site, flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)), called Bcon/NotI/Phas3' cassette.

The Bcon/NotI/Phas3' cassette was removed from pKR85 (SEQ ID NO:27) by digestion with HindIII and the resulting fragment was re-ligated to produce pKR278 (SEQ ID NO:104).

The BsiWI fragment of pKR1235 (SEQ ID NO:74, Example 14), containing the YL DGAT1, was cloned into the BsiWI site of pKR278 (SEQ ID NO:104), which was previously described in BB1574; published in US20080095915 (the contents of which are incorporated by reference), to produce pKR1274 (SEQ ID NO:105).

Construction of pKR1267 Comprising GM FAD2-TE2 Down-Regulation Cassette

The 5' end of GM TE2 (SEQ ID NO:106) was amplified from pTC4 (SEQ ID NO:107), which was previously described in WO1996006936A1 (the contents of which are incorporated by reference), with oligonucleotide primers GmTE2_5-1 (SEQ ID NO:108) and GmTE2_3-1 (SEQ ID NO:109), using the Phusion™ High-Fidelity DNA Polymerase (Cat. No. F553S, Finnzymes Oy, Finland) following the manufacturer's protocol. The 3' end of GM TE2 (SEQ ID NO:106) was amplified from pTC4 (SEQ ID NO:107) with oligonucleotide primers GmTE2_5-2 (SEQ ID NO:110) and GmTE2_3-2 (SEQ ID NO:111), using the Phusion™ High-Fidelity DNA Polymerase (Cat. No. F553S, Finnzymes Oy, Finland) following the manufacturer's protocol. The resulting two PCR products were combined and amplified with GmTE2_5-1 (SEQ ID NO:108) and GmTE2_3-2 (SEQ ID NO:111) using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1258 (SEQ ID NO:112).

The 5' end of GM FAD2 (SEQ ID NO:113) was amplified from pBS43 (SEQ ID NO:114), which was previously described in WO1997047731A2 (the contents of which are incorporated by reference), with oligonucleotide primers GmFAD2-1_5-1 (SEQ ID NO:115) and GmFAD2-1_3-1 (SEQ ID NO:116), using the Phusion™ High-Fidelity DNA Polymerase (Cat. No. F553S, Finnzymes Oy, Finland) following the manufacturer's protocol. The 3' end of GM FAD2-1 (SEQ ID NO:113) was amplified from pBS43 (SEQ ID NO:114) with oligonucleotide primers GmFAD2-1_5-2 (SEQ ID NO:117) and GmFAD2-1_3-2 (SEQ ID NO:118), using the Phusion™ High-Fidelity DNA Polymerase (Cat. No. F553S, Finnzymes Oy, Finland) following the manufacturer's protocol. The resulting two PCR products were combined and amplified with GmFAD2-1_5-1 (SEQ ID NO:115) and GmFAD2-1_3-2 (SEQ ID NO:118) using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce PCRblunt-Fad2-1 (SEQ ID NO:119).

The MluI fragment of pKR1258 (SEQ ID NO:112), containing GM TE2, was cloned into the MluI fragment of PCR-blunt-Fad2-1 (SEQ ID NO:119), containing GM FAD2-1, to produce pKR1259 (SEQ ID NO:120).

The EcoRI fragment of pKR1259 (SEQ ID NO:120) comprised of the 5' end of the GM FAD2/TE2 fragment, was cloned into the MfeI site of pKR1259 (SEQ ID NO:122) to produce pKR1261 (SEQ ID NO:121) and forms a GM FAD2-TE2-TE2loop-TE2-FAD2 haripin structure flanked by NotI sites.

The NotI fragment of pKR1261 (SEQ ID NO:121), containing GM FAD2-TE2-TE2loop-TE2-FAD2, was cloned into the NotI site of pKR123R (SEQ ID NO:122), which was previously described in WO2004071467A2 (the contents of which are incorporated by reference), to produce pKR1266 (SEQ ID NO:123).

The BsiWI/PstI fragment of pKR1266 (SEQ ID NO:123), containing the GM FAD2-TE2-TE2loop-TE2-FAD2 was cloned into the BsiWI/SbfI fragment of pKR278 (SEQ ID NO:104) to produce pKR1267 (SEQ ID NO:124).

Construction of pKR1269 Comprising GM FAD2-TE2 Down-Regulation Cassette

The NotI fragment of pKR1261 (SEQ ID NO:121), containing GM FAD2-TE2-TE2loop-TE2-FAD2, was cloned into the NotI site of pKR457 (SEQ ID NO:125), which was previously described in PCT Publication No. WO 2005/047479 (the contents of which are hereby incorporated by reference), to produce pKR1264 (SEQ ID NO:126).

The PstI fragment of pKR1264 (SEQ ID NO:126), containing the GM FAD2-TE2-TE2loop-TE2-FAD2 was cloned into the SbfI fragment of pKR277 (SEQ ID NO:127), which was previously described in PCT Publication No. WO 2004/071467 to produce pKR1269 (SEQ ID NO:128).

Co-Expression of GM FAD2-TE2-TE2loop-TE2-FAD2 Down-Regulation Constructs Either Alone or with YL DGAT2

Soybean embryogenic suspension culture (cv. Jack) was transformed with the pKR1267 (SEQ ID NO:124) alone and having experiment number MSE2213 or with the BsiWI fragment of pKR1269 (SEQ ID NO:128) and pKR1274 (SEQ ID NO:105) and having experiment number MSE2210. Events were selected and somatic embryos matured in SHaM as described in Example 5. Oil concentrations and fatty acid profiles were determined as described in Example 4 for MSE2213 and MSE2210 and results for each experiment are shown in Table 35 and Table 36, respectively.

TABLE 35

Oil concentrations and fatty acid profiles for events from MSE2213.
MSE2213 (GM FAD2-TE2-TE2loop-TE2-FAD2)

| Event | 16:0 | 18:0 | 18:1 | 18:2 | 18:3 | % Oil |
|---|---|---|---|---|---|---|
| 2213-16 | 5.8 | 2.6 | 72.7 | 10.5 | 8.5 | 16.8 |
| 2213-26 | 12.0 | 5.7 | 24.8 | 47.2 | 10.4 | 16.5 |
| 2213-30 | 11.7 | 5.3 | 18.5 | 53.1 | 11.4 | 15.4 |
| 2213-23 | 9.0 | 3.2 | 52.2 | 24.7 | 11.0 | 15.3 |
| 2213-29 | 13.1 | 3.7 | 13.3 | 57.1 | 12.8 | 15.0 |
| 2213-7 | 6.4 | 3.1 | 66.3 | 15.6 | 8.6 | 14.9 |
| 2213-31 | 11.7 | 3.0 | 26.9 | 46.5 | 11.9 | 14.5 |
| 2213-13 | 6.7 | 3.3 | 64.5 | 16.6 | 8.9 | 14.4 |
| 2213-5 | 3.5 | 3.0 | 78.0 | 7.5 | 8.1 | 13.8 |
| 2213-9 | 7.6 | 3.4 | 57.6 | 20.3 | 11.0 | 13.2 |
| 2213-20 | 7.8 | 4.1 | 56.7 | 20.8 | 10.6 | 13.1 |
| 2213-4 | 4.1 | 2.7 | 72.1 | 11.1 | 10.0 | 12.7 |
| 2213-17 | 7.7 | 5.2 | 57.0 | 19.7 | 10.4 | 12.5 |
| 2213-3 | 7.4 | 3.6 | 64.4 | 14.4 | 10.2 | 12.5 |
| 2213-24 | 12.9 | 7.3 | 29.4 | 39.0 | 11.4 | 12.1 |
| 2213-1 | 13.8 | 7.1 | 22.1 | 44.6 | 12.4 | 11.9 |
| 2213-6 | 6.7 | 2.2 | 57.2 | 22.2 | 11.7 | 11.8 |
| 2213-11 | 9.2 | 5.2 | 58.2 | 16.4 | 11.0 | 10.9 |
| 2213-2 | 7.8 | 4.3 | 45.3 | 31.0 | 11.7 | 10.6 |
| 2213-14 | 7.3 | 4.6 | 63.0 | 15.0 | 10.2 | 10.5 |
| 2213-27 | 8.5 | 6.0 | 48.9 | 25.0 | 11.6 | 10.1 |
| 2213-19 | 8.0 | 4.0 | 53.7 | 21.4 | 12.8 | 9.9 |
| 2213-21 | 11.1 | 5.6 | 28.3 | 40.6 | 14.4 | 9.8 |
| 2213-18 | 7.4 | 4.1 | 57.2 | 17.7 | 13.5 | 9.4 |
| 2213-12 | 6.4 | 4.3 | 63.2 | 15.5 | 10.6 | 9.4 |

TABLE 35-continued

Oil concentrations and fatty acid profiles for events from MSE2213.
MSE2213 (GM FAD2-TE2-TE2loop-TE2-FAD2)

| Event | 16:0 | 18:0 | 18:1 | 18:2 | 18:3 | % Oil |
|---|---|---|---|---|---|---|
| 2213-10 | 13.8 | 7.0 | 24.0 | 42.1 | 13.2 | 9.4 |
| 2213-28 | 8.8 | 4.1 | 54.1 | 19.1 | 13.8 | 9.1 |
| 2213-25 | 6.9 | 3.5 | 53.9 | 21.9 | 13.8 | 9.0 |
| 2213-15 | 5.2 | 3.4 | 61.7 | 17.6 | 12.1 | 8.0 |
| 2213-8 | 14.4 | 6.6 | 20.0 | 42.9 | 16.1 | 7.6 |
| 2213-22 | 14.3 | 6.3 | 21.3 | 41.9 | 16.2 | 7.2 |
| Avg. | 8.9 | 4.4 | 47.9 | 27.1 | 11.6 | 11.9 |

TABLE 36

Oil concentrations and fatty acid profiles for events from MSE2210
MSE2210 (YL DGAT1 & GM FAD2-TE2-TE2loop-TE2-FAD2)

| Event | 16:0 | 18:0 | 18:1 | 18:2 | 18:3 | % Oil |
|---|---|---|---|---|---|---|
| 2210-2 | 3.8 | 2.7 | 74.7 | 13.1 | 5.8 | 22.1 |
| 2210-23 | 10.3 | 6.8 | 32.0 | 44.4 | 6.5 | 20.0 |
| 2210-29 | 7.5 | 5.5 | 63.9 | 17.1 | 6.0 | 20.0 |
| 2210-19 | 3.9 | 3.5 | 79.1 | 8.1 | 5.4 | 19.7 |
| 2210-10 | 7.3 | 3.8 | 66.6 | 15.6 | 6.7 | 19.6 |
| 2210-12 | 5.7 | 3.6 | 67.6 | 17.6 | 5.6 | 19.6 |
| 2210-14 | 4.5 | 2.4 | 67.9 | 17.8 | 7.4 | 19.3 |
| 2210-25 | 5.1 | 3.5 | 71.8 | 13.1 | 6.4 | 18.4 |
| 2210-5 | 9.0 | 4.1 | 43.1 | 35.9 | 7.9 | 17.8 |
| 2210-24 | 13.7 | 4.3 | 20.5 | 52.5 | 9.1 | 17.5 |
| 2210-13 | 10.2 | 5.5 | 36.8 | 40.4 | 7.0 | 17.4 |
| 2210-11 | 10.9 | 7.8 | 30.6 | 43.2 | 7.5 | 16.6 |
| 2210-1 | 4.1 | 3.0 | 75.6 | 9.6 | 7.7 | 15.9 |
| 2210-6 | 2.7 | 1.7 | 83.9 | 5.3 | 6.4 | 15.5 |
| 2210-16 | 8.4 | 3.7 | 48.5 | 31.3 | 8.1 | 15.3 |
| 2210-26 | 7.1 | 4.9 | 55.2 | 24.7 | 8.1 | 14.4 |
| 2210-7 | 4.3 | 3.2 | 62.9 | 20.8 | 8.7 | 14.3 |
| 2210-20 | 6.8 | 4.3 | 65.2 | 15.7 | 7.9 | 13.8 |
| 2210-27 | 10.9 | 7.4 | 42.4 | 30.0 | 9.3 | 13.8 |
| 2210-30 | 5.0 | 2.4 | 65.1 | 17.1 | 10.4 | 13.7 |
| 2210-3 | 7.1 | 4.8 | 52.9 | 27.4 | 7.9 | 13.6 |
| 2210-4 | 6.0 | 3.7 | 66.0 | 15.9 | 8.5 | 13.3 |
| 2210-22 | 3.2 | 3.3 | 77.7 | 8.1 | 7.8 | 13.2 |
| 2210-8 | 9.1 | 4.9 | 49.7 | 27.3 | 9.0 | 13.1 |
| 2210-21 | 6.0 | 3.5 | 67.8 | 14.9 | 7.8 | 12.8 |
| 2210-18 | 12.7 | 5.2 | 20.2 | 49.7 | 12.1 | 12.5 |
| 2210-31 | 4.4 | 2.9 | 73.1 | 10.1 | 9.5 | 11.7 |
| 2210-9 | 4.0 | 3.1 | 74.1 | 9.3 | 9.6 | 11.2 |
| 2210-15 | 3.5 | 2.4 | 72.5 | 11.0 | 10.6 | 11.1 |
| 2210-28 | 14.1 | 5.7 | 20.2 | 45.5 | 14.5 | 10.1 |
| 2217-29 | 12.0 | 7.5 | 28.0 | 38.8 | 13.8 | 8.7 |
| Avg. | 7.2 | 4.2 | 56.6 | 23.6 | 8.4 | 15.4 |

Comparison of results in Tables 35 and 36 demonstrates that combination of YL DGAT1 expression with down-regulation of GM FAD2-1 and GM TE2 changes the fatty acid profile to an extend that exceeds the change that observed when only FAD2-1 and TE2 genes are suppressed.

SEQUENCE LISTING (128 sequences)

SEQ ID NO: 1 - DNA, 1581 bp, Yarrowia lipoytica
atggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtag

SEQ ID NO: 2 - DNA, 8325 bp, Artificial Sequence
  plasmid pYDA1
aaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtc

SEQ ID NO: 3 - DNA, 7518 bp, Artificial Sequence
  plasmid pY75
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagc

SEQ ID NO: 4 - DNA, 9109 bp, Artificial Sequence
  plasmid pY75 YLDGAT1
catggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggcc

SEQ ID NO: 5 - DNA, 6849 bp, Artificial Sequence
  plasmid pRS425
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 6 - DNA, 7494 bp, Artificial Sequence
  plasmid pGPD425
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagtgatttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaaatcccgc

SEQ ID NO: 7 - DNA, 36 bp, Artificial Sequence
  plasmid oYLDGAT2-1
gcggccgcatgactatcgactcacaatactacaagt

SEQ ID NO: 8 - DNA, 36 bp, Artificial Sequence
  plasmid oYLDGAT2-2
gcggccgcttactcaatcattcggaactctggggct

SEQ ID NO: 9 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 10 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 11 - DNA, 9070 bp, Artificial Sequence
  plasmid pY75 YLDGAT2
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagcccagagttccgaatgattgagtaagc

SEQ ID NO: 12 - DNA, 32 bp, Artificial Sequence
  primer YDGAT1-F
gatcatccatggaagtccgacgacgaaaaatc

SEQ ID NO: 13 - DNA, 36 bp, Artificial Sequence
  primer YDGAT1-R
gatcaagcggccgcctactggttctgcttgtagttg

SEQ ID NO: 14 - DNA, 35 bp, Artificial Sequence
  primer YDGAT2-F
gatcatccatggctatcgactcacaatactacaag

SEQ ID NO: 15 - DNA, 37 bp, Artificial Sequence
  primer YDGAT2-R
gatcatgcggccgcttactcaatcattcggaactctg

SEQ ID NO: 16 - DNA, 1603 bp, Yarrowia lipolytica
gatcatccatggaagtccgacgacgaaaaatcgacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttattatctggcttacaactacaagcagaaccagtaggcggccgcttgatc

SEQ ID NO: 17 - DNA, 1567 bp, Yarrowia lipolytica
gatcatccatggctatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcatgatc

SEQ ID NO: 18 - DNA, 6991 bp, Artificial Sequence
  plasmid pFBAIN-MOD-1
gcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgg

SEQ ID NO: 19 - DNA, 8568 bp, Artificial Sequence
  plasmid pFBAIN-YLDGAT1
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaagtccgacgacgaaaaatcgacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttattatctggcttacaactacaagcagaaccagtaggc

SEQ ID NO: 20 - DNA, 8532 bp, Artificial Sequence
  plasmid pFBAIN-YLDGAT2
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggctatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 21 - DNA, 7049 bp, Artificial Sequence
  plasmid pKS123
agcttggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaaca

SEQ ID NO: 22 - DNA, 1098 bp, Artificial Sequence
  cal a24-4
aggatcctgcaggcagccaagaaggttttggagcgagttccaatctcaaaaccgccattcgaatacaatgatctgaagaaagcagtaccaccacattgtttttcacgaccactttcccgatccttgtatttcctctttcacgacattattgtaacatgtatccttttctacgtagcatcaaactacattcatatgctccctcgtttcctttcctgcatcgtatggcctgtttactggatctcccaaggagtttttctcggcagattgtggatgatcggccacgaatgcggtcatcatagcttcagtaattaccgttgggtcgacgatacagtcggttttctaatccatacggccaccctcactccctatttttccttcaaatatagccaccgtaatcaccatgcacacaccaattccatggaatacgacgaggttcatatcccgaaacgcaaatcagaagctctctactttgaatttctgggcaacaacccaatcggcttaatgatcaccatgctatgtaaactgactttcggatatgcagcttacattatgttcaattacacaggtaagaagcacaaatctgggggcttagcgagccacttctacccacaaagccctctctttaacgacagcgaacgtaaccatgttttgttctctgacatcgggatttgcatcgtcttgtacgcgtgttaccgtattgtgacggtcacaggggcaatgccggcattttatgtgtacggtattccttgggttataatgagtgctattctctttgcagcaacttatttacaacacactcatccttcaatccctcattatgatacaacggagtggaactggcttagaggggctttatcgacaattgatagagatttagggttcttcaacatgaacaaaacacattatcatgttatccaccatttgtttcctgtcattccggaataccatgcacaagaggcaaccgaggccatcaagcccatcttaggtcaatattacaagtatgatggtactccgtttctaaaggccttgtggagagaaatgaaggagtgtatttatgtagaatccgatgaaggtcagaagaaacctgcaggagatctt

SEQ ID NO: 23 - DNA, 30 bp, Artificial Sequence
  primer oCal-15
aggatcctgcaggcagccaagaaggttttg

SEQ ID NO: 24 - DNA, 29 bp, Artificial Sequence
  primer oCal-6
aagatctcctgcaggtttcttctgacctc

SEQ ID NO: 25 - DNA, 8138 bp, Artificial Sequence
  plasmid pKR53B
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatctcctgcaggtttcttctgaccttcatcggattctacataaatacactccttcatttctctccacaaggcctttagaaacggagtaccatcatacttgtaatattgacctaagatgggcttgatggcctcggttgcctcttgtgcatggtattccggaatgacaggaaacaaatggtggataacatgataatgtgttttgttcatgttgaagaaccctaaatctctatcaattgtcgataaagcccctctaagccagttccactccgttgtatcataatgagggattgaaggatgagtgtgttgtaaataagttgctgcaaagagaatagcactcattataacccaaggaataccgtacacataaaatgccggcattgcccctgtgaccgtcacaatacggtaacacgcgtacaagacgatgcaaatcccgatgtcagagaacaaaacatggttacgttcgctgtcgttaaagagagggctttgtgggtagaagtggctcgctaagcccccagatttgtgcttcttacctgtgtaattgaacataatgtaagctgcatatccgaaagtcagtttacatagcatggtgatcattaagccgattgggttgttgcccagaaattcaaagtagagagcttctgatttgcgtttcgggatatgaacctcgtcgtattccatggaattggtgtgtgcatggtgattacggtggctatatttgaaggaaaaatagggagtgagggtggccgtatggattagaaaaccgactgtatcgtcgacccaacggtaattactgaagctatgatgaccgcattcgtggccgatcatccacaatctgccgagaaaaactccttgggagatccagtaaacaggccatacgatgcaggaaaggaaacgagggagcatatgaatgtagtttgatgctacgtagaaaaggatacatgttacaataatgtcgtgaaagaggaaatacaaggatcgggaaagtggtcgtgaaaaacaatgtggtggtactgctttcttcagatcattgtattcgaatggcggttttgagattggaactcgctccaaaaccttcttggctgcctgcag

SEQ ID NO: 26 - DNA, 7085 bp, Artificial Sequence
  plasmid pKR72
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctc

SEQ ID NO: 27 - DNA, 7085 bp, Artificial Sequence
  plasmid pKR85
cgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatctcctgcaggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacgg

SEQ ID NO: 28 - DNA, 22 bp, Artificial Sequence
  primer oKR85-1
actcgaggcgcgccgtcgacgg

SEQ ID NO: 29 - DNA, 18 bp, Artificial Sequence
  primer oKR85-2
aagatctggcgcgccaag

SEQ ID NO: 30 - DNA, 4827 bp, Artificial Sequence
  plasmid pPCR85
actcgaggcgcgccgtcgacggatccgtacgagatccggccggccagatcctgcaggagatccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggcgcgccagatcttgggctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgccc

SEQ ID NO: 31 - DNA, 15114 bp, Artificial Sequence
  plasmid pKR91
gatctggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatctcctgcaggatctggccggccggatctcgtacggatccgtcgacggcgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagatctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagag

SEQ ID NO: 32 - DNA, 13268 bp, Artificial Sequence
  plasmid pKR92
cgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagtctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatctgg

SEQ ID NO: 33 - DNA, 19604 bp, Artificial Sequence
  plasmid pKR92 YLDGAT2
  misc_feature (4526)..(4526): n is a, c, g, or t
cgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagtctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatctgg

SEQ ID NO: 34 - DNA, 20082 bp, Artificial Sequence
  plasmid pKR92 YLDGAT1 YLDGAT2
cgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagtctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatctgg

SEQ ID NO: 35 - DNA, 3527 bp, Glycine max
tagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgttgtccctcattcaccttcctctcttccctataaataaccacgcctcaggttctccgcttcacaactcaaacattctcctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtccatcttgtccaaacttcacatataaatatataatagacttaaatatgtttaagggtttgataaatgagggaattttattttagatttttaataattttttttgttttgagtttttatatattaaaatttttgttttgatttcttccatatgacgtaacataatcatatcattgataatgttgggttcctaatttttgtttgtttgttgttttgtaatatgaataggtaagggtatttttggcatgatatacccgggttgtcctagcacatttgaagagcctcaacaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctagggtgagccacatagcaatattagatattataattctttaaaggtttaaatatcattttagttcgtggagttgcactttctaatttagtacctatagattaaaatatgccaattgaatccttatagttgtgtttttttatccaatttggttcttgtcttgaaataaatggacaatattgtagctgataaaaaaaggaaactggactacattgtaacgttaagattagaattcttaagttctaatactagctggttacagattgacaactatttgttttgacaattcttggcagagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgataaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaaggtacgtacatcattcatcaaagatcaacatacatttatacattaaactaatatttgttgccaaatatttattaattttattgataattaatttttttagaaaatttgtttgatcacttttaatggagtctttcatcttaattacattatttatacttagactaatgatttattgattaataataatcttagatacactataaaatgtgtgacggagttatcttaacacttgcatggattctatcttttctgtctttatatatagaaatagagagaaaaaaaaagaaaagattgatgaaaaaagcaaaacaaaaaatagtattattataaaaatattggatgaatttgttgtgactcttgcatgcattgatgtacgatgcagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggcttagagccctttttgtatgtgctaccccacttttgtctttttggcaatagtgctagcaaccaataaataataataataataatgaataagaaaacaaaggctttagcttgccttttgttcactgtaaaataataatgtaagtactctctataatgagtcacgaaacttttgcgggaataaaaggagaaattccaatgagttttctgtcaaatcttcttttgtctctctctctctctcttttttttttctttcttctgagcttcttgcaaaacaaaaggcaaacaataacgattggtccaatgatagttagcttgatcgatgatatctttaggaagtgttggcaggacaggacatgatgtagaagactaaaattgaaagtattgcagacccaatagttgaagattaactttaagaatgaagacgtcttatcaggttcttcatgacttggagctc

SEQ ID NO: 36 - DNA, 690 bp, Glycine max
tagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgttgtccctcattcaccttcctctcttccctataaataaccacgcctcaggttctccgcttcacaactcaaacattctcctccattggtccttaaacactcatcagtcatcacc

SEQ ID NO: 37 - DNA, 36 bp, Artificial Sequence
  primer oGY1-1
cgcggatcctagcctaagtacgtactcaaaatgcca

SEQ ID NO: 38 - DNA, 39 bp, Artificial Sequence
  primer oGY1-2
gaattcccatggggtgatgactgatgagtgtttaaggac

SEQ ID NO: 39 - DNA, 6660 bp, Artificial Sequence
  plasmid pZBL114
cggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgctctagaactagtggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggccaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcggtggggaattccccgggggtacctctagacatggccacgtgcatgaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggacgactctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctttgctctagactggaattcgtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgat

SEQ ID NO: 40 - DNA, 1437 bp, Artificial Sequence
  GM GY1 gene
atgggttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcaacaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggcttagggtacc

SEQ ID NO: 41 - DNA, 204 bp, Artificial Sequence
  synthetic BHL8 gene
atggctaagattaagtgcacgtggcctgagctggtgggcaagaccgtggagaaagccaagaagatgatcatgaaggacaagccagaggcgaagatcatggttctgccagttgggaccaaagtgaccggtgaatggaagatggatcgcgtccgcctctgggtcgataagaaggacaagatcgccaagactccgaagtgcggctag

SEQ ID NO: 42 - DNA, 1701 bp, Artificial Sequence
  GY1-BHL8 fusion product
atggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcagcaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggctggtggtggatctatggctaagattaagtgcacgtggcctgagctggtgggcaagaccgtggagaaagccaagaagatgatcatgaaggacaagccagaggcgaagatcatggttctgccagttgggaccaaagtgaccggtgaatggaagatggatcgcgtccgcctctgggtcgataagaaggacaagatcgccaagactccgaagtgcggctag

SEQ ID NO: 43 - DNA, 6493 bp, Artificial Sequence
  plasmid pZBL133
cggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgctctagaactagtggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcagcaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggctggtggtggatctatggctaagattaagtgcacgtggcctgagctggtgggcaagaccgtggagaaagccaagaagatgatcatgaaggacaagccagaggcgaagatcatggttctgccagttgggaccaaagtgaccggtgaatggaagatggatcgcgtccgcctctgggtcgataagaaggacaagatcgccaagactccgaagtgcggctagggtacctctagacatggccacgtgcatgaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggacgactctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctttgctctagactggaattcgtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgat

SEQ ID NO: 44 - DNA, 6472 bp, Artificial Sequence
  plasmid pKS238
ctagactggaattcgtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgctctagaactagtggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcagcaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggctggtggtggatctatggctaagattaagtgcacgtggcctgagctggtgggcaagaccgtggagaaagccaagaagatgatcatgaaggacaagccagaggcgaagatcatggttctgccagttgggaccaaagtgaccggtgaatggaagatggatcgcgtccgcctctgggtcgataagaaggacaagatcgccaagactccgaagtgcggctagggtacctctagggtggcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagct

SEQ ID NO: 45 - DNA, 6259 bp, Artificial Sequence
  plasmid pKS240
ctctagggtggcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgctctagaactagtggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcagcaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggcttagggtac

SEQ ID NO: 46 - DNA, 5267 bp, Artificial Sequence
  plasmid pKS120
atctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcga

SEQ ID NO: 47 - DNA, 8643 bp, Artificial Sequence
  plasmid pKS242
tcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcagcaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggcttagggtacctctagggtggcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcg

SEQ ID NO: 48 - DNA, 8720 bp, Artificial Sequence
  plasmid pKS349
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagc

SEQ ID NO: 49 - DNA, 5280 bp, Artificial Sequence
  plasmid pKS121/BS
  misc_feature (4090)..(4090): n is a, c, g, or t
ggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggcgcgccgtcgacggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaagtgtgttattaacccttctcttcgaggatccaagcttggcgcg

SEQ ID NO: 50 - DNA, 5968 bp, Artificial Sequence
  plasmid pDs-Red in pKS121/BS
  misc_feature (5052)..(5052): n is a, c, g, or t
catggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggcccgcgccaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcc

SEQ ID NO: 51 - DNA, 10058 bp, Artificial Sequence
  plasmid pKS332
  misc_feature (1178)..(1178): n is a, c, g, or t
gatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttg

SEQ ID NO: 52 - DNA, 11611 bp, Artificial Sequence
  plasmid pKS362
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 53 - DNA, 1422 bp, Glycine max
ggatccaactaaaaaaagctctcaaattacattttgagttgtttcaggttccattgccttattgctaaaactccaactaaaataacaaatagcacatgcaggtgcaaacaacacgttactctgatgaaggtgatgtgcctctagcagtctagcttatgaggctcgctgcttatcaacgattcatcattccccaagacgtgtacgcagattaaacaatggacaaaacttcaatcgattatagaataataattttaacagtgccgacttttttctgtaaacaaaaggccagaatcatatcgcacatcatcttgaatgcagtgtcgagtttggaccatttgagtacaaagccaatattgaatgatttttcgattttacatgtgtgaatcagacaaaagtgcatgcaatcacttgcaagtaaattaaggatactaatctattcctttcattttatatgctccacttttatataaaaaaatatacattattatatatgcattattaattattgcagtattatgctattggttttatggccctgctaaataacctaaatgagtctaactattgcatatgaatcaaatgaaggaagaatcatgatctaaacctgagtacccaatgcaataaaatgcgtcctattacctaaacttcaaacacacattgccatcggacgtataaattaatgcatatagattattttgagaaaagaaaacatcaaaagctctaaaacttcttttaactttgaaataagctgataaaaatacgctttaaatcaactgtgtgctgtatataagctgcaatttcacattttaccaaaccgaaacaagaatggtaacagtgaggcaaaaatttgaaaaatgtcctacttcacattcacatcaaattaattacaactaaataaataaacatcgtgattcaagcagtaatgaaagtcgaaatcagatagaatatacacgtttaacatcaattgaatttttttttaaatggatatatacaagtttactattttatatataatgaaaattcattttgtgttagcacaaaacttacagaaagagataaattttaaataaagagaattatatccaattttataatccaaaataatcaaattaaagaatattggctagatagaccggctttttcactgcccctgctggataatgaaaattcatatcaaaacaatacagaagttctagtttaataataaaaaagttggcaaactgtcattccctgttggtttttaagccaaatcacaattcaattacgtatcagaaattaatttaaaccaaatatatagctacgagggaacttcttcagtcattactagctagctcactaatcactatatatacgacatgctacaagtgaagtgaccatatcttaatttcaaatcataaaattcttccaccaagttgcggccgc

SEQ ID NO: 54 - DNA, 41 bp, Artificial Sequence
  primer oP34-1
cgcggatccaactaaaaaaagctctcaaattacattttgag

SEQ ID NO: 55 - DNA, 44 bp, Artificial Sequence
  primer oP34-2
gaattcgcggccgcaacttggtggaagaattttatgatttgaaa

SEQ ID NO: 56 - DNA, 7466 bp, Artificial Sequence
  plasmid pZBL115
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctctagcccggccgcctccagctttctttcctccctgcattttcaaagatcaattatttcctttctttgtttctcacttaggttctttcttctttcaacagcacaccgcatgctaccaaataaatagatttaggtgcggcgctatcttttgcacacgtgtcagtgcagtacgcgtggcaagtttctgaggattattggactaatcgtcttacacgtaattgccgcgtgtctgtttgcaacgagcttcaacacagtgttagggacacgtggcaatcaaccactcgtgcaataggggcttacataaacggtcgattaatctaattggggatgaaattgacttctcttatcccttccaaattgtctctccgttatcccttccaaatgatgttaagatttgtattaatatttaaaatgatatcattttgaaagaataatttgaaaaaggataataaaaagttaaatcaaatgcgaaatatactaaaagttattgattaaagttattgattaaaattattgctaatcatctctcaactctcaaatgtttctctttaattctatgcaacttaagctctaattaatagcacttactagtagttagaggcagataaaaacatgaagaaaaaaaaaactttctttatcaattgatacaagaatatgatcctttatttatattaaagtggaagtgacatttagcctatcgcacgtagtgttgaaccattcctcaattgaaagagaatgtgaagggtgaattgaaaagaaaaaagagagatggaaaggaagaatttgaaatagagatagaacaacaaagtttagctctttgccttcgtacatatattttaaaaatattatttttcagtacaaaaatcgcaataatgtcacactatgatttatgtatgacattgttgtaagttggtgtggcgtaagtacttgattaaattatttatcaaatgcaatttgcaaaacaattttgaatgaatttgtttaaaaagtattgctgttaaattttttatcttagaagaattgagggatcgggcg

SEQ ID NO: 57 - DNA, 7841 bp, Artificial Sequence
  plasmid pJS89
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcaacttggtggaagaattttatgatttgaaattaagatatggtcacttcacttgtagcatgtcgtatatatagtgattagtgagctagctagtaatgactgaagaagttccctcgtagctatatatttggtttaaattaatttctgatacgtaattgaattgtgatttggcttaaaaaccaacagggaatgacagtttgccaacttttttattattaaactagaacttctgtattgttttgatatgaattttcattatccagcaggggcagtgaaaaagccggtctatctagccaatattctttaatttgattattttggattataaaattggatataattctctttatttaaaatttatctctttctgtaagttttgtgctaacacaaaatgaattttcattatatataaaatagtaaacttgtatatatccatttaaaaaaaaattcaattgatgttaaacgtgtatattctatctgatttcgactttcattactgcttgaatcacgatgtttatttatttagttgtaattaatttgatgtgaatgtgaagtaggacatttttcaaatttttgcctcactgttaccattcttgtttcggtttggtaaaatgtgaaattgcagcttatatacagcacacagttgatttaaagcgtatttttatcagcttatttcaaagttaaaagaagttttagagcttttgatgttttcttttctcaaaataatctatatgcattaatttatacgtccgatggcaatgtgtgtttgaagtttaggtaataggacgcattttattgcattgggtactcaggtttagatcatgattcttccttcatttgattcatatgcaatagttagactcatttaggttatttagcagggccataaaaccaatagcataatactgcaataattaataatgcatatataataatgtatatttttttatataaaagtggagcatataaaatgaaaggaatagattagtatccttaatttacttgcaagtgattgcatgcacttttgtctgattcacacatgtaaaatcgaaaaatcattcaatattggctttgtactcaaatggtccaaactcgacactgcattcaagatgatgtgcgatatgattctggccttttgtttacagaaaaaagtcggcactgttaaaattattattctataatcgattgaagttttgtccattgtttaatctgcgtacacgtcttggggaatgatgaatcgttgataagcagcgagcctcataagctagactgctagaggcacatcaccttcatcagagtaacgtgttgtttgcacctgcatgtgctatttgttattttagttggagttttagcaataaggcaatggaacctgaaacaactcaaaatgtaatttgagagctttttttagttg

SEQ ID NO: 58 - DNA, 1390 bp, Morteriella alpina
gcggccgcatggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctgcctccaagatgggtaaggcgcagtaagcggccgc

SEQ ID NO: 59 - DNA, 9223 bp, Artificial Sequence
  plasmid pJS93
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcttactgcgccttacccatcttggaggcagccttggagacctcgttcagacggctaaagacctctgcagttccctcgatcataccggtggtgtggtatcggacattgtactttttgcacagggtctcgacagcaggctggatctttgaaaagttgtggcgaggcatcgaagggaacaagtggtgctcgatctgatagttcaatccacccgtgaaccagttggcaaatagacccgggtggacatcacgacccgtgatgatctgcttcgtgaagaaatccatatcgaccgcctcctccttcgagatcacaggcataccgttgtggttgagcgagaacacgatcgccaacaagtttccgcacaccgcctgcgacaccaaaaagtacaccagcatgttgacgggatccttgatgaacaggaacatggtggcgaggtaccaggtccagtgcatcgcaagcgacagctgctcgaccaacgagatgggcacacgcgcgcccgagggcttgtgggcctgaccgttaggcagcacaaagagaatggactggaggcaccaggagagacgggcaaacgagagaatggggaagtaaaaccaggtctggttcaggaccatgaaacgcgaccacatgcgggtcagctcctcatctgggacatccgagaacatctccaacgcatgctcactccaggtcaacagagggtgggtgtcaatgtcgggatcctcgccgtggacgttgggggcggcgtggtgagtgttgtgcttgtccttccaccacgaggacgagaagccctggcagacacctcccaagaaggcgccgaaaagatcaccccagaaacggtcctggaagacctggtgatgcaaaaagtcgtgagccaaccatccgcactgctgccagaacagacccaaaagcgcagccgagagcacgttggcgagggtcgaggtctggccccacttggccacaatgaccgtcgacaaaccccagatgcagaggttgaacgagaccttgaaggcgtagtatgccttggaagaatcgtagtaaccaagagactggaacaaggtacgcagcttgcggacctcggccgcaaagtcatcattcttgatatcgcggtcgctctcgtcaatatcaccaacgtaaaagttggcaagagtctcccaagcagcctcggggtgaaaagtgtcaaagacgtcagtgccgtccttgccaacgtgcgtgagaatcacacttccaccgggatgatcagggacgaactcgcggacatcgtacaccttgttgtcgatgatcatcaagaagggtgcctcggcatccttcttgccctcattcagagcctcggcattcaaaacctcggcccgagtaaacgtcctcacactgggagcagcagccatgcggccgcaacttggtggaagaattttatgatttgaaattaagatatggtcacttcacttgtagcatgtcgtatatatagtgattagtgagctagctagtaatgactgaagaagttccctcgtagctatatatttggtttaaattaatttctgatacgtaattgaattgtgatttggcttaaaaaccaacagggaatgacagtttgccaacttttttattattaaactagaacttctgtattgttttgatatgaattttcattatccagcaggggcagtgaaaaagccggtctatctagccaatattctttaatttgattattttggattataaaattggatataattctctttatttaaaatttatctctttctgtaagttttgtgctaacacaaaatgaattttcattatatataaaatagtaaacttgtatatatccatttaaaaaaaaattcaattgatgttaaacgtgtatattctatctgatttcgactttcattactgcttgaatcacgatgtttatttatttagttgtaattaatttgatgtgaatgtgaagtaggacatttttcaaatttttgcctcactgttaccattcttgtttcggtttggtaaaatgtgaaattgcagcttatatacagcacacagttgatttaaagcgtatttttatcagcttatttcaaagttaaaagaagttttagagcttttgatgttttcttttctcaaaataatctatatgcattaatttatacgtccgatggcaatgtgtgtttgaagtttaggtaataggacgcattttattgcattgggtactcaggtttagatcatgattcttccttcatttgattcatatgcaatagttagactcatttaggttatttagcagggccataaaaccaatagcataatactgcaataattaataatgcatatataataatgtatatttttttatataaaagtggagcatataaaatgaaaggaatagattagtatccttaatttacttgcaagtgattgcatgcacttttgtctgattcacacatgtaaaatcgaaaaatcattcaatattggctttgtactcaaatggtccaaactcgacactgcattcaagatgatgtgcgatatgattctggccttttgtttacagaaaaaagtcggcactgttaaaattattattctataatcgattgaagttttgtccattgtttaatctgcgtacacgtcttggggaatgatgaatcgttgataagcagcgagcctcataagctagactgctagaggcacatcaccttcatcagagtaacgtgttgtttgcacctgcatgtgctatttgttattttagttggagttttagcaataaggcaatggaacctgaaacaactcaaaatgtaatttgagagctttttttagttg

SEQ ID NO: 60 - DNA, 7472 bp, Artificial Sequence
  plasmid pKS127
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatccgttgaaacatccctgaagtgtctcattttattttatttattctttgctgataaaaaaataaaataaaagaagctaagcacacggtcaaccattgctttactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtcctccttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacgtgcattttagttcatacttgcggccgctctagcccggccgcctccagctttctttcctccctgcattttcaaagatcaattatttcctttctttgtttctcacttaggttctttcttctttcaacagcacaccgcatgctaccaaataaatagatttaggtgcggcgctatcttttgcacacgtgtcagtgcagtacgcgtggcaagtttctgaggattattggactaatcgtcttacacgtaattgccgcgtgtctgtttgcaacgagcttcaacacagtgttagggacacgtggcaatcaaccactcgtgcaataggggcttacataaacggtcgattaatctaattggggatgaaattgacttctcttatcccttccaaattgtctctccgttatcccttccaaatgatgttaagatttgtattaatatttaaaatgatatcattttgaaagaataatttgaaaaaggataataaaaagttaaatcaaatgcgaaatatactaaaagttattgattaaagttattgattaaaattattgctaatcatctctcaactctcaaatgtttctctttaattctatgcaacttaagctctaattaatagcacttactagtagttagaggcagataaaaacatgaagaaaaaaaaaactttctttatcaattgatacaagaatatgatcctttatttatattaaagtggaagtgacatttagcctatcgcacgtagtgttgaaccattcctcaattgaaagagaatgtgaagggtgaattgaaaagaaaaaagagagatggaaaggaagaatttgaaatagagatagaacaacaaagtttagctctttgccttcgtacatatattttaaaaatattatttttcagtacaaaaatcgcaataatgtcacactatgatttatgtatgacattgttgtaagttggtgtggcgtaagtacttgattaaattatttatcaaatgcaatttgcaaaacaattttgaatgaatttgtttaaaaagtattgctgttaaattttttatcttagaagaattgagggatcgggcg

SEQ ID NO: 61 - DNA, 7847 bp, Artificial Sequence
  plasmid pKS343
ggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccaactaaaaaaagctctcaaattacattttgagttgtttcaggttccattgccttattgctaaaactccaactaaaataacaaatagcacatgcaggtgcaaacaacacgttactctgatgaaggtgatgtgcctctagcagtctagcttatgaggctcgctgcttatcaacgattcatcattccccaagacgtgtacgcagattaaacaatggacaaaacttcaatcgattatagaataataattttaacagtgccgacttttttctgtaaacaaaaggccagaatcatatcgcacatcatcttgaatgcagtgtcgagtttggaccatttgagtacaaagccaatattgaatgatttttcgattttacatgtgtgaatcagacaaaagtgcatgcaatcacttgcaagtaaattaaggatactaatctattcctttcattttatatgctccacttttatataaaaaaatatacattattatatatgcattattaattattgcagtattatgctattggttttatggccctgctaaataacctaaatgagtctaactattgcatatgaatcaaatgaaggaagaatcatgatctaaacctgagtacccaatgcaataaaatgcgtcctattacctaaacttcaaacacacattgccatcggacgtataaattaatgcatatagattattttgagaaaagaaaacatcaaaagctctaaaacttcttttaactttgaaataagctgataaaaatacgctttaaatcaactgtgtgctgtatataagctgcaatttcacattttaccaaaccgaaacaagaatggtaacagtgaggcaaaaatttgaaaaatgtcctacttcacattcacatcaaattaattacaactaaataaataaacatcgtgattcaagcagtaatgaaagtcgaaatcagatagaatatacacgtttaacatcaattgaatttttttttaaatggatatatacaagtttactattttatatataatgaaaattcattttgtgttagcacaaaacttacagaaagagataaattttaaataaagagaattatatccaattttataatccaaaataatcaaattaaagaatattggctagatagaccggctttttcactgcccctgctggataatgaaaattcatatcaaaacaatacagaagttctagtttaataataaaaaagttggcaaactgtcattccctgttggtttttaagccaaatcacaattcaattacgtatcagaaattaatttaaaccaaatatatagctacgagggaacttcttcagtcattactagctagctcactaatcactatatatacgacatgctacaagtgaagtgaccatatcttaatttcaaatcataaaattcttccaccaagttgc

SEQ ID NO: 62 - DNA, 10866 bp, Artificial Sequence
  plasmid pKS352
  misc_feature (9689)..(9689): n is a, c, g, or t
agcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccaactaaaaaaagctctcaaattacattttgagttgtttcaggttccattgccttattgctaaaactccaactaaaataacaaatagcacatgcaggtgcaaacaacacgttactctgatgaaggtgatgtgcctctagcagtctagcttatgaggctcgctgcttatcaacgattcatcattccccaagacgtgtacgcagattaaacaatggacaaaacttcaatcgattatagaataataattttaacagtgccgacttttttctgtaaacaaaaggccagaatcatatcgcacatcatcttgaatgcagtgtcgagtttggaccatttgagtacaaagccaatattgaatgatttttcgattttacatgtgtgaatcagacaaaagtgcatgcaatcacttgcaagtaaattaaggatactaatctattcctttcattttatatgctccacttttatataaaaaaatatacattattatatatgcattattaattattgcagtattatgctattggttttatggccctgctaaataacctaaatgagtctaactattgcatatgaatcaaatgaaggaagaatcatgatctaaacctgagtacccaatgcaataaaatgcgtcctattacctaaacttcaaacacacattgccatcggacgtataaattaatgcatatagattattttgagaaaagaaaacatcaaaagctctaaaacttcttttaactttgaaataagctgataaaaatacgctttaaatcaactgtgtgctgtatataagctgcaatttcacattttaccaaaccgaaacaagaatggtaacagtgaggcaaaaatttgaaaaatgtcctacttcacattcacatcaaattaattacaactaaataaataaacatcgtgattcaagcagtaatgaaagtcgaaatcagatagaatatacacgtttaacatcaattgaatttttttttaaatggatatatacaagtttactattttatatataatgaaaattcattttgtgttagcacaaaacttacagaaagagataaattttaaataaagagaattatatccaattttataatccaaaataatcaaattaaagaatattggctagatagaccggctttttcactgcccctgctggataatgaaaattcatatcaaaacaatacagaagttctagtttaataataaaaaagttggcaaactgtcattccctgttggtttttaagccaaatcacaattcaattacgtatcagaaattaatttaaaccaaatatatagctacgagggaacttcttcagtcattactagctagctcactaatcactatatatacgacatgctacaagtgaagtgaccatatcttaatttcaaatcataaaattcttccaccaagttgcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccaagctgatccactagttctagagcggcccgcgccgtcgacggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccggccgctacaggaacaggtggtggcggccctcggcgcgctcgtactgctccacgatggtgtagtcctcgttgtgggaggtgatgtccagcttggagtccacgtagtagtagccgggcagctgcacgggcttcttggccatgtagatggacttgaactccaccaggtagtggccgccgtccttcagcttcagggccttgtggatctcgcccttcagcacgccgtcgcgggggtacaggcgctcggtggaggcctcccagcccatagtcttcttctgcattacggggccgtcggaggggaagttcacgccgatgaacttcaccttgtagatgaaggagccgtcctgcagggaggagtcctgggtcacggtcaccacgccgccgtcctcgaagttcatcacgcgctcccacttgaagccctcggggaaggacagcttcttgtagtcggggatgtcggcggggtgcttcacgtacaccttggagccgtactggaactggggggacaggatgtcccaggcgaagggcagggggccgcccttggtcaccttcagcttggcggtctgggtgccctcgtaggggcggccctcgccctcgccctcgatctcgaactcgtggccgttcacggagccctccatgcgcaccttgaagcgcatgaactccttgatgacgtcctcggaggaggccatgggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaagtgtgttattaacccttctcttcgaggatc

SEQ ID NO: 63 - DNA, 12055 bp, Artificial Sequence
  plasmid pKS364
agcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgcca

SEQ ID NO: 64 - DNA, 1581 bp, Yarrowia lipolytica
atggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctccaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactccagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtag

SEQ ID NO: 65 - protein, 526 aa, Yarrowia lipolytica
MEVRRRKIDVLKAQKNGYESGPPSRQSSQPSSRASSRTRNKHSSSTLSLSGLTMKVQKKPAGPPANSKTPFLHIKPVHTCCSTSMLSRDYDGSNPSFKGFKNIGMIILIVGNLRLAFENYLKYGISNPFFDPKITPSEWQLSGLLIVVAYAHILMAYAIESAAKLLFLSSKHHYMAVGLLHTMNTLSSISLLSYVVYYYLPNPVAGTIVEFVAVILSLKLASYALTNSDLRKAAIHAQKLDKTQDDNEKESTSSSSSSDDAETLADIDVIPAYYAQLPYPQNVTLSNLLYFWFAPTLVYQPVYPKTERIRPKHVIRNLFELVSLCMLIQFLIFQYAYPIMQSCLALFFQPKLDYANISERLMKLASVSMMVWLIGFYAFFQNGLNLIAELTCFGNRTFYQQWWNSRSIGQYWTLWNKPVNQYFRHHVYVPLLARGMSRFNASVVVFFFSAVIHELLVGIPTHNIIGAAFFGMMSQVPLIMATENLQHINSSLGPFLGNCAFWFTFFLGQPTCAFLYYLAYNYKQNQ

SEQ ID NO: 66 - DNA, 1545 bp, Yarrowia lipolytica
atgaccatcgactcccagtactacaagtcccgcgacaagaacgacaccgctcccaagattgctggtatccgctacgctcctctgtctactccactcttgaaccgctgcgagactttctctttggtgtggcacatcttctccatccctaccttcctcaccatcttcatgctctgctgtgccattcccttgctctggcccttcgtgatcgcttacgttgtgtacgccgtgaaggatgactccccttccaacggcggtgttgtgaagcgctattcccctatctcccgcaacttcttcatctggaagctctttggccgctacttccccatcaccctccacaagaccgttgatttggagcccacccacacttactatcccttggacgtccaagagtaccacctgattgctgagcgctattggcctcagaacaagtacctgcgcgccatcattaccaccatcgagtacttcctgcccgctttcatgaagcgttccctctccatcaacgagcaggagcagcctgctgagagagaccctctgttgtctcccgtttccccctcttctcctggttctcagcccgacaagtggatcaaccatgattcccgctattccagaggtgagtcctctggctccaatggtcatgcttctggctctgaactgaatggcaatggcaacaacggcactaccaatcgccgccctctttcttctgcttccgctggctctactgcttctgactctaccttgctcaacggctctctcaactcctacgccaaccagatcattggcgagaacgaccctcagttgtctcccactaagctcaagcctactggcaggaagtacatcttcgggtaccatcctcacggtatcattgggatgggcgcctttggtggcattgctactgaaggtgctggctggtccaagctctttcctggtatccccgtttccctcatgaccctcaccaacaactttcgcgttcctctctatcgcgagtacctcatgtccctgggcgttgcttccgtttctaagaagtcctgtaaggccctcctcaagcgtaatcagtccatctgcatcgtggtgggtggtgcccaggaatccttgttggctaggcctggtgttatggatctcgtgttgctgaagcgcaagggttttgtgcgcttgggtatggaggtgggcaatgttgccctcgttccaatcatggctttcggcgagaacgatctctacgaccaggtgtccaacgacaagtcctccaagctgtaccgcttccagcagttcgtgaagaacttcctcggcttcaccctccctctcatgcatgccagaggtgtgttcaactacgatgttgggctcgttccctaccgccgccctgtgaacattgtggttggttctcctatcgacttgccttacctccctcatcccaccgatgaggaagtttccgagtaccacgaccgttacatcgctgagctccagcgcatctacaacgagcacaaggacgagtacttcatcgactggactgaggagggtaagggcgctcctgagtttcgtatgatcgagtag

SEQ ID NO: 67 - protein, 514 aa, Yarrowia lipolytica; identical to SEQ ID NO: 10

SEQ ID NO: 68 - DNA, 8638 bp, Artificial Sequence
  plasmid pKR1234
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 69 - DNA, 21 bp, Artificial Sequence
  primer oSGly-2
aagcggccgcggtgatgactg

SEQ ID NO: 70 - DNA, 32 bp, Artificial Sequence
  primer oSGly-3
taagcttcgtacgctagcctaagtacgtactc

SEQ ID NO: 71 - DNA, 3673 bp, Artificial Sequence
  plasmid pPSgly32
gggctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgccctaagcttcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgctt

SEQ ID NO: 72 - DNA, 4171 bp, Artificial Sequence
  plasmid pKR264
gcccgggggatccgccctaagcttcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgca

SEQ ID NO: 73 - DNA, 6130 bp, Artificial Sequence
  plasmid pKR1212
ctagaggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaaaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagct

SEQ ID NO: 74 - DNA, 5764 bp, Artificial Sequence
  plasmid pKR1235
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcagcccgggggatccgccctaagcttcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaaaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagc

SEQ ID NO: 75 - DNA, 11693 bp, Artificial Sequence
  plasmid pKR1236
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctactggttctgcttgtagttgtaggccaaatagtaaaggaatgcacaagtgggttgtcccaggaaaaaggtgaaccagaatgcacagttgccaaggaaggggcccagagaggagttaatatgctgaaggttctcagtagccatgatcagaggcacctgcgacatcatgccgaagaaggcggctccgatgatgttgtgagtggggatgccgacaagcagttcatggatgacggcggagaaaaagaaaaccaccaccgacgcattgaaccgcgacatgccccgagcgagaagaggcacgtagacgtggtgtctaaagtactggttgactggcttgttccatagagtccagtactggccaatggagcgggaattccaccactgctggtagaaggttctgtttccaaaacaggtgagctcggcaataagattgagaccgttctggaagaaagcgtagaatccaatgagccagaccatcatagacacggaggccaacttcatgaggcgctcggagatgttggcataatcgagcttgggctggaagaacagagccagacacgactgcatgatggggtaggcgtactggaagatgagaaactgaataagcatgcacagagagacgagctcaaacaggtttcggatcacgtgcttgggtcgaatacgctccgtcttggggtacacgggctggtagaccagtgtgggagcaaaccagaagtacagcaggttcgacagcgtcacattctgggggtagggcagctgtgcgtagtatgcaggaatgacgtcaatgtctgccaaagtctctgcgtcatctgaagaagaggaagacgaggtggattccttttcgttatcgtcttgcgtcttgtcgagcttctgggcatgaattgcggcttttcggagatccgagttagtgagggcgtatgaggcgagtttgagagacagaataacggccacaaactcgactattgtgcctgccacggggttgggcaggtagtagtagacgacgtaggacagcaacgagatggacgacaaagtgttcatggtatgcagaagccccacggccatgtagtggtgtttgctagagaggaacagcagcttggcagcgctctcaatagcgtaggccatgaggatatgtgcgtaggccacgactatgagcaagcctgagagctgccactcggaaggagtaattttggggtcgaagaacgggttggaaatgccgtatttgaggtagttttcgaatgcgagccgtagatttcccacaatgagaatgatcatgccgatgtttttgaagcccttgaagctggggttggagccgtcataatcgcgcgaaagcattgatgtggagcagcacgtgtgcacgggcttgatgtgtaggaatggcgttttggagttcgccgggggtcccgcaggtttcttctggactttcatggtcagtccgctgagcgacagggtggacgaggagtgtttgttgcgggttctggacgatgctcttgaggagggctgcgacgattgtcgagatggtgggcccgattcgtagccgtttttctgggccttgagcacgtctatctttcgtcgtcggacctccatggtttgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagc

SEQ ID NO: 76 - DNA, 34 bp, Artificial Sequence
  primer oYDG2-1
agcggccgcaacatgactatcgactcacaatact

SEQ ID NO: 77 - DNA, 25 bp, Artificial Sequence
  primer oYDG2-2
tgcggccgcttactcaatcattcgg

SEQ ID NO: 78 - DNA, 5079 bp, Artificial Sequence
  plasmid pKR1254
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcacctg

SEQ ID NO: 79 - DNA, 34 bp, Artificial Sequence
  primer YlD2_Y326F-5
cttccgagtgcctctcttcagagagtacctcatg

SEQ ID NO: 80 - DNA, 34 bp, Artificial Sequence
  primer YlD2_Y326F-3
catgaggtactctctgaagagaggcactcggaag

SEQ ID NO: 81 - DNA, 5079 bp, Artificial Sequence
  plasmid pKR1254_Y326F
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcacctg

SEQ ID NO: 82 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 83 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLFREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 84 - DNA, 34 bp, Artificial Sequence
  primer YlD2_Y326L-5
cttccgagtgcctctcctcagagagtacctcatg

SEQ ID NO: 85 - DNA, 34 bp, Artificial Sequence
  primer YlD2_Y326L-3
catgaggtactctctgaggagaggcactcggaag

SEQ ID NO: 86 - DNA, 5079 bp, Artificial Sequence
  plasmid pKR1254_Y326L
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcctcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcacctg

SEQ ID NO: 87 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcctcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 88 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLLREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 89 - DNA, 35 bp, Artificial Sequence
  primer YlD2_R327K-5
ccgagtgcctctctacaaagagtacctcatgagtc

SEQ ID NO: 90 - DNA, 35 bp, Artificial Sequence
  primer YlD2_R327K-3
gactcatgaggtactctttgtagagaggcactcgg

SEQ ID NO: 91 - DNA, 5079 bp, Artificial Sequence
  plasmid pKR1254_R327K
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacaaagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcacctg

SEQ ID NO: 92 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacaaagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 93 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYKEYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 94 - DNA, 9074 bp, Artificial Sequence
  plasmid pY191
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 95 - DNA, 9074 bp, Artificial Sequence
  plasmid pY192
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 96 - DNA, 9074 bp, Artificial Sequence
  plasmid pY193
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcctcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 97 - DNA, 9074 bp, Artificial Sequence
  plasmid pY194
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacaaagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 98 - DNA, 8641 bp, Artificial Sequence
  plasmid pKR1256
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 99 - DNA, 8641 bp, Artificial Sequence
  plasmid pKR1277
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 100 - DNA, 8641 bp, Artificial Sequence
  plasmid pKR1278
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcctcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 101 - DNA, 11647 bp, Artificial Sequence
  plasmid pKS392
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctccaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactccagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtaggc

SEQ ID NO: 102 - DNA, 11611 bp, Artificial Sequence
  plasmid pKS393
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgaccatcgactcccagtactacaagtcccgcgacaagaacgacaccgctcccaagattgctggtatccgctacgctcctctgtctactccactcttgaaccgctgcgagactttctctttggtgtggcacatcttctccatccctaccttcctcaccatcttcatgctctgctgtgccattcccttgctctggcccttcgtgatcgcttacgttgtgtacgccgtgaaggatgactccccttccaacggcggtgttgtgaagcgctattcccctatctcccgcaacttcttcatctggaagctctttggccgctacttccccatcaccctccacaagaccgttgatttggagcccacccacacttactatcccttggacgtccaagagtaccacctgattgctgagcgctattggcctcagaacaagtacctgcgcgccatcattaccaccatcgagtacttcctgcccgctttcatgaagcgttccctctccatcaacgagcaggagcagcctgctgagagagaccctctgttgtctcccgtttccccctcttctcctggttctcagcccgacaagtggatcaaccatgattcccgctattccagaggtgagtcctctggctccaatggtcatgcttctggctctgaactgaatggcaatggcaacaacggcactaccaatcgccgccctctttcttctgcttccgctggctctactgcttctgactctaccttgctcaacggctctctcaactcctacgccaaccagatcattggcgagaacgaccctcagttgtctcccactaagctcaagcctactggcaggaagtacatcttcgggtaccatcctcacggtatcattgggatgggcgcctttggtggcattgctactgaaggtgctggctggtccaagctctttcctggtatccccgtttccctcatgaccctcaccaacaactttcgcgttcctctctatcgcgagtacctcatgtccctgggcgttgcttccgtttctaagaagtcctgtaaggccctcctcaagcgtaatcagtccatctgcatcgtggtgggtggtgcccaggaatccttgttggctaggcctggtgttatggatctcgtgttgctgaagcgcaagggttttgtgcgcttgggtatggaggtgggcaatgttgccctcgttccaatcatggctttcggcgagaacgatctctacgaccaggtgtccaacgacaagtcctccaagctgtaccgcttccagcagttcgtgaagaacttcctcggcttcaccctccctctcatgcatgccagaggtgtgttcaactacgatgttgggctcgttccctaccgccgccctgtgaacattgtggttggttctcctatcgacttgccttacctccctcatcccaccgatgaggaagtttccgagtaccacgaccgttacatcgctgagctccagcgcatctacaacgagcacaaggacgagtacttcatcgactggactgaggagggtaagggcgctcctgagtttcgtatgatcgagtaggc

SEQ ID NO: 103 - DNA, 11649 bp, Artificial Sequence
  plasmid pKS391
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggcccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggcc

SEQ ID NO: 104 - DNA, 5303 bp, Artificial Sequence
  plasmid pKR278
agcttggatctcctgcaggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgcca

SEQ ID NO: 105 - DNA, 8358 bp, Artificial Sequence
  plasmid pKR1274
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaaaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcac

SEQ ID NO: 106 - DNA, 1251 bp, Glycine max
atggtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaactggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacaacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgaggggcaggactgagtggaggcccaaacctgtgaacaactttggtgttgtgaaccaggttccagcagaaagcacctaa

SEQ ID NO: 107 - DNA, 9592 bp, Artificial Sequence
  plasmid pTC4
  misc_feature (3725)..(3725): n is a, c, g, or t
ggccgctacatggccacgtgcatgaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggacgactctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctttgctctagactggaattcgtcgactctagaggatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaatagtgagatccaacacttacgtttgcaacgtccaagagcaaatagaccacgnacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcggtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccggccgcagatttaggtgacactatagaatatgcatcactagtaagctaagcttgatccatgcccttcatttgccgctattaattaatttggtaacagtagtccgtactaatcagttacttatccttcctccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgaatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatatctgcaatctcggcccaggttttcatcatcaagaaccagttcaatatcctagtacaccgtattaaagaatttaagatatactaacagcggccgctgacacaatagcccttcttccctgtttccagcttttctccttctctctctctccatcttcttcttcttcttcactcagtcagatccaactcctcagataacacaagaccaaacccgctttttctgcatttctagactagacgttctaccggagaagcgaccttagaaattcattatggtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaactggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacaacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgaggggcaggactgagtggaggcccaaacctgtgaacaactttggtgttgtgaaccaggttccagcagaaagcacctaagatttgaaatggttaacgattggagttgcatcagtctccttgctatgtttagacttattctggttccctggggagagttttgcttgtgtctatccaatcaatctacatgtctttaaatatatacaccttctaatttgtgatactttggtgggtaagggggaaaagcagcagtaaatcgc

SEQ ID NO: 108 - DNA, 28 bp, Artificial Sequence
  primer GmTE2 5-1
aaacgcgtgtggcaacagctgctacttc

SEQ ID NO: 109 - DNA, 51 bp, Artificial Sequence
  primer GmTE2 3-1
gctcttgtcaagatttcaccgaattcttaagttttggagtcacgtaaaagc

SEQ ID NO: 110 - DNA, 51 bp, Artificial Sequence
  primer GmTE2 5-2
gcttttacgtgactccaaaacttaagaattcggtgaaatcttgacaagagc

SEQ ID NO: 111 - DNA, 60 bp, Artificial Sequence
  primer GmTE2 3-2
tcgcggccgctgtacaggaacaattgtgattaattagtcacaatctcagcaccattttcc

SEQ ID NO: 112 - DNA, 4738 bp, Artificial Sequence
  plasmid pKR1258
aattcaggaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattgttcctgtacagcggccgcgacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcag

SEQ ID NO: 113 - DNA, 1164 bp, Glycine max
atgggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgaccgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattgggtgagtactaccaatttgatgacacaccattttacaaggcactgtggagagaagcgagagagtgcctctatgtggagccagatgaaggaacatccgagaagggcgtgtattggtacaggaacaagtattga

SEQ ID NO: 114 - DNA, 10303 bp, Artificial Sequence
  plasmid pBS43
  misc_feature (3347)..(3347): n is a, c, g, or t
gtcgactctagaggatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggccaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcggtggggaattccccgggggtacctaatagtgagatccaacacttacgtttgcaacgtccaagagcaaatagaccacgnacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcggtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgcagatttaggtgacactatagaatatgcatcactagtaagcttgatccatgcccttcatttgccgctattaattaatttggtaacagtagtccgtactaatcagttacttatccttcctccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgaatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatatctgcaatctcggcccaggttttcatcatcaagaaccagttcaatatcctagtacaccgtattaaagaatttaagatatactaacgtagcccatcgaattcccatatactaatatttgcttgtattgatagcccctccgttcccaagagtataaaactgcatcgaataatacaagccactaggcatgggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgaccgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattgggtgagtactaccaatttgatgacacaccattttacaaggcactgtggagagaagcgagagagtgcctctatgtggagccagatgaaggaacatccgagaagggcgtgtattggtacaggaacaagtattgatggagcaaccaatgggccatagtgggagttatggaagttttgtcatgtattagtacataattagtagaatgttataaataagtggatttgccgcgtaatgactttgtgtgtattgtgaaacagcttgttgcgatcatggttataatgtaaaaataattctggtattaattacatgtggaaagtgttctgcttatagctttctgcctaaaaaaaaagaattcctgcagcccgggtctagacatggccacgtgcatgaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggacgactctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctttgctctagactggaattc

SEQ ID NO: 115 - DNA, 50 bp, Artificial Sequence
  primer GmFad2-1 5-1
gcggccgcggtacctaattaactaggtctagcaaaggaaacaacaatggg

SEQ ID NO: 116 - DNA, 48 bp, Artificial Sequence
  primer GmFad2-1 3-1
gggacaaacacttcatcacgagatcttagtcaagggaacctgtgttgg

SEQ ID NO: 117 - DNA, 48 bp, Artificial Sequence
  primer GmFad2-1 5-2
ccaacacaggttcccttgactaagatctcgtgatgaagtgtttgtccc

SEQ ID NO: 118 - DNA, 34 bp, Artificial Sequence
  primer GmFad2-1 3-2
acacgcgtttaaaatattggcttgattgcattgg

SEQ ID NO: 119 - DNA, 4584 bp, Artificial Sequence
  plasmid PCRblunt-Fad2-1
ttgtaatacgactcactatagggcgaattgggccctctagatgcatgctcgagcggccgccagtgtgatggatatctgcagaattcagggcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtcctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaa

SEQ ID NO: 120 - DNA, 5797 bp, Artificial Sequence
  plasmid pKR1259
cgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattgttcctgtacagcggccgccctgaattccagcacactggcggccgttactagtggatccgagctcggtaccaagcttgatgcatagcttgagtattctaa

SEQ ID NO: 121 - DNA, 7590 bp, Artificial Sequence
  plasmid pKR1261
aattgttcctgtacagcggccgccctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattcttaagttttggagtcacgtaaaagccaatcacgacgcataccattcttccctgatccagaaacccaagtgtccacttgaactatgtcaccccatgtaggatagcgttccaccacaacctgcatccgagtaaccacccatatcaagttctttttgcacatttctggcgtggaaccaaagccatcaccaagaagcccagcacttttaacatgattaagtgcagtttcttgcaaatggttcattactgtttctatagatgcggtacgatcagcaccaatctcatatgatctaatagaaaagttttcacggaacacaagaccatcctgaacaatttttcctatcccaaaggggtcaataagcatgtcaggtcgccgtggcttccaatcaagcatcatccactgcttttcagcggccaagaaaattgttgtgatagcagcaagaagcatgctccaatcaggcaactggttgataaaagttctggggggaggcgaaggtagatcatcatcatgcttgaagctttctttagatgtaacaactgtggttccattaattttcgaaggggcttgcgcctttgccttcaagccaccagaagacgcagatttggattttagtcctccaaggtttgcaggcccaccaccaagtttgctgcctgctccaccagagtccggcgagggtgaagtaacagggaaaaatgatgaagtagcagctgttgccacacgcgtttaaaatattggcttgattgcattggttgcctccattgcatggtaatgtggcattgtagagaagagatggtgagccacatgagtatcagttatgtgatgaaacaccttgttcagaatcccataatctctgtccatagttgccaaagctcccttcagccagtcccattctgatgaatcgtaatgaggcaaggcaaagtgtgtgtgctgcaaatatgtgatagtcacaagaaaaccgttcacaatgagcaaaggcaccccataaacacatagcagccaaaccaaccctttcagggttgcaacacggtagagagagtaagtcacagaaaacaaagcaacatcagagacatagatcagaagcctctcacggttagaatatatgggagcataagggtggtagtggcttgcaaaactatcatagggtctaccagagacattgaaggctaaatacataggccaccctattgtgagtgtgacgagaagagaaacagcccttcctagagggttgtttaagtacttggaaaaccatgcaactttggattttggttttgggacaaacacttcatcacgagatcttagtcaagggaacctgtgttggagtgatggcggcgatggcttattttccatgagaaataagggactaaaagtgttgagtgaagggtcaaacccacaacatcatcaacccattggtacttgctgaaggcatggtgaccacactcgtgagcaatcacccacacaccagtgagaaggcaaccttggagaacccaatagattggccatgcaatgagggaaaagggttgaggaaggaggtggaagtaggtggtggcaatgtagaaaatgaaggcaaatgaaaggtcataaacaacataggagaatgaagtgaggagggagcgctgaaagcagtgtggtggaattgctttcttgagttggccaacagtgaatggtggctttgtgtttggaacccttgagagaggcttcttcccttgaacttccactttggccacacgacctctacctcccattgttgtttcctttgctagacctagttaattaggtaccgcggccgccctg

SEQ ID NO: 122 - DNA, 4993 bp, Artificial Sequence
  plasmid pKR123R
  misc_feature (1126)..(1126): n is a, c, g, or t
ctagacctgcaggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcct

SEQ ID NO: 123 - DNA, 9036 bp, Artificial Sequence
  plasmid pKR1266
  misc_feature (4081)..(4081): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatcctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattcttaagttttggagtcacgtaaaagccaatcacgacgcataccattcttccctgatccagaaacccaagtgtccacttgaactatgtcaccccatgtaggatagcgttccaccacaacctgcatccgagtaaccacccatatcaagttctttttgcacatttctggcgtggaaccaaagccatcaccaagaagcccagcacttttaacatgattaagtgcagtttcttgcaaatggttcattactgtttctatagatgcggtacgatcagcaccaatctcatatgatctaatagaaaagttttcacggaacacaagaccatcctgaacaatttttcctatcccaaaggggtcaataagcatgtcaggtcgccgtggcttccaatcaagcatcatccactgcttttcagcggccaagaaaattgttgtgatagcagcaagaagcatgctccaatcaggcaactggttgataaaagttctggggggaggcgaaggtagatcatcatcatgcttgaagctttctttagatgtaacaactgtggttccattaattttcgaaggggcttgcgcctttgccttcaagccaccagaagacgcagatttggattttagtcctccaaggtttgcaggcccaccaccaagtttgctgcctgctccaccagagtccggcgagggtgaagtaacagggaaaaatgatgaagtagcagctgttgccacacgcgtttaaaatattggcttgattgcattggttgcctccattgcatggtaatgtggcattgtagagaagagatggtgagccacatgagtatcagttatgtgatgaaacaccttgttcagaatcccataatctctgtccatagttgccaaagctcccttcagccagtcccattctgatgaatcgtaatgaggcaaggcaaagtgtgtgtgctgcaaatatgtgatagtcacaagaaaaccgttcacaatgagcaaaggcaccccataaacacatagcagccaaaccaaccctttcagggttgcaacacggtagagagagtaagtcacagaaaacaaagcaacatcagagacatagatcagaagcctctcacggttagaatatatgggagcataagggtggtagtggcttgcaaaactatcatagggtctaccagagacattgaaggctaaatacataggccaccctattgtgagtgtgacgagaagagaaacagcccttcctagagggttgtttaagtacttggaaaaccatgcaactttggattttggttttgggacaaacacttcatcacgagatcttagtcaagggaacctgtgttggagtgatggcggcgatggcttattttccatgagaaataagggactaaaagtgttgagtgaagggtcaaacccacaacatcatcaacccattggtacttgctgaaggcatggtgaccacactcgtgagcaatcacccacacaccagtgagaaggcaaccttggagaacccaatagattggccatgcaatgagggaaaagggttgaggaaggaggtggaagtaggtggtggcaatgtagaaaatgaaggcaaatgaaaggtcataaacaacataggagaatgaagtgaggagggagcgctgaaagcagtgtggtggaattgctttcttgagttggccaacagtgaatggtggctttgtgtttggaacccttgagagaggcttcttcccttgaacttccactttggccacacgacctctacctcccattgttgtttcctttgctagacctagttaattaggtaccgc

SEQ ID NO: 124 - DNA, 11615 bp, Artificial Sequence
  plasmid pKR1267
  misc_feature (6454)..(6454): n is a, c, g, or t
ggagatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattcttaagttttggagtcacgtaaaagccaatcacgacgcataccattcttccctgatccagaaacccaagtgtccacttgaactatgtcaccccatgtaggatagcgttccaccacaacctgcatccgagtaaccacccatatcaagttctttttgcacatttctggcgtggaaccaaagccatcaccaagaagcccagcacttttaacatgattaagtgcagtttcttgcaaatggttcattactgtttctatagatgcggtacgatcagcaccaatctcatatgatctaatagaaaagttttcacggaacacaagaccatcctgaacaatttttcctatcccaaaggggtcaataagcatgtcaggtcgccgtggcttccaatcaagcatcatccactgcttttcagcggccaagaaaattgttgtgatagcagcaagaagcatgctccaatcaggcaactggttgataaaagttctggggggaggcgaaggtagatcatcatcatgcttgaagctttctttagatgtaacaactgtggttccattaattttcgaaggggcttgcgcctttgccttcaagccaccagaagacgcagatttggattttagtcctccaaggtttgcaggcccaccaccaagtttgctgcctgctccaccagagtccggcgagggtgaagtaacagggaaaaatgatgaagtagcagctgttgccacacgcgtttaaaatattggcttgattgcattggttgcctccattgcatggtaatgtggcattgtagagaagagatggtgagccacatgagtatcagttatgtgatgaaacaccttgttcagaatcccataatctctgtccatagttgccaaagctcccttcagccagtcccattctgatgaatcgtaatgaggcaaggcaaagtgtgtgtgctgcaaatatgtgatagtcacaagaaaaccgttcacaatgagcaaaggcaccccataaacacatagcagccaaaccaaccctttcagggttgcaacacggtagagagagtaagtcacagaaaacaaagcaacatcagagacatagatcagaagcctctcacggttagaatatatgggagcataagggtggtagtggcttgcaaaactatcatagggtctaccagagacattgaaggctaaatacataggccaccctattgtgagtgtgacgagaagagaaacagcccttcctagagggttgtttaagtacttggaaaaccatgcaactttggattttggttttgggacaaacacttcatcacgagatcttagtcaagggaacctgtgttggagtgatggcggcgatggcttattttccatgagaaataagggactaaaagtgttgagtgaagggtcaaacccacaacatcatcaacccattggtacttgctgaaggcatggtgaccacactcgtgagcaatcacccacacaccagtgagaaggcaaccttggagaacccaatagattggccatgcaatgagggaaaagggttgaggaaggaggtggaagtaggtggtggcaatgtagaaaatgaaggcaaatgaaaggtcataaacaacataggagaatgaagtgaggagggagcgctgaaagcagtgtggtggaattgctttcttgagttggccaacagtgaatggtggctttgtgtttggaacccttgagagaggcttcttcccttgaacttccactttggccacacgacctctacctcccattgttgtttcctttgctagacctagttaattaggtaccgcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatcctgca

SEQ ID NO: 125 - DNA, 5252 bp, Artificial Sequence
  plasmid pKR457
  misc_feature (3872)..(3872): n is a, c, g, or t
gtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 126 - DNA, 9295 bp, Artificial Sequence
  plasmid pKR1264
  misc_feature (4340)..(4340): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattcttaagttttggagtcacgtaaaagccaatcacgacgcataccattcttccctgatccagaaacccaagtgtccacttgaactatgtcaccccatgtaggatagcgttccaccacaacctgcatccgagtaaccacccatatcaagttctttttgcacatttctggcgtggaaccaaagccatcaccaagaagcccagcacttttaacatgattaagtgcagtttcttgcaaatggttcattactgtttctatagatgcggtacgatcagcaccaatctcatatgatctaatagaaaagttttcacggaacacaagaccatcctgaacaatttttcctatcccaaaggggtcaataagcatgtcaggtcgccgtggcttccaatcaagcatcatccactgcttttcagcggccaagaaaattgttgtgatagcagcaagaagcatgctccaatcaggcaactggttgataaaagttctggggggaggcgaaggtagatcatcatcatgcttgaagctttctttagatgtaacaactgtggttccattaattttcgaaggggcttgcgcctttgccttcaagccaccagaagacgcagatttggattttagtcctccaaggtttgcaggcccaccaccaagtttgctgcctgctccaccagagtccggcgagggtgaagtaacagggaaaaatgatgaagtagcagctgttgccacacgcgtttaaaatattggcttgattgcattggttgcctccattgcatggtaatgtggcattgtagagaagagatggtgagccacatgagtatcagttatgtgatgaaacaccttgttcagaatcccataatctctgtccatagttgccaaagctcccttcagccagtcccattctgatgaatcgtaatgaggcaaggcaaagtgtgtgtgctgcaaatatgtgatagtcacaagaaaaccgttcacaatgagcaaaggcaccccataaacacatagcagccaaaccaaccctttcagggttgcaacacggtagagagagtaagtcacagaaaacaaagcaacatcagagacatagatcagaagcctctcacggttagaatatatgggagcataagggtggtagtggcttgcaaaactatcatagggtctaccagagacattgaaggctaaatacataggccaccctattgtgagtgtgacgagaagagaaacagcccttcctagagggttgtttaagtacttggaaaaccatgcaactttggattttggttttgggacaaacacttcatcacgagatcttagtcaagggaacctgtgttggagtgatggcggcgatggcttattttccatgagaaataagggactaaaagtgttgagtgaagggtcaaacccacaacatcatcaacccattggtacttgctgaaggcatggtgaccacactcgtgagcaatcacccacacaccagtgagaaggcaaccttggagaacccaatagattggccatgcaatgagggaaaagggttgaggaaggaggtggaagtaggtggtggcaatgtagaaaatgaaggcaaatgaaaggtcataaacaacataggagaatgaagtgaggagggagcgctgaaagcagtgtggtggaattgctttcttgagttggccaacagtgaatggtggctttgtgtttggaacccttgagagaggcttcttcccttgaacttccactttggccacacgacctctacctcccattgttgtttcctttgctagacctagttaattaggtaccgc

SEQ ID NO: 127 - DNA, 2577 bp, Artificial Sequence
  plasmid pKR1277
agcttggatctcctgcaggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgcca

SEQ ID NO: 128 - DNA, 9219 bp, Artificial Sequence
  plasmid pKR1269
  misc_feature (3769)..(3769): n is a, c, g, or t
ggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattcttaagttttggagtcacgtaaaagccaatcacgacgcataccattcttccctgatccagaaacccaagtgtccacttgaactatgtcaccccatgtaggatagcgttccaccacaacctgcatccgagtaaccacccatatcaagttctttttgcacatttctggcgtggaaccaaagccatcaccaagaagcccagcacttttaacatgattaagtgcagtttcttgcaaatggttcattactgtttctatagatgcggtacgatcagcaccaatctcatatgatctaatagaaaagttttcacggaacacaagaccatcctgaacaatttttcctatcccaaaggggtcaataagcatgtcaggtcgccgtggcttccaatcaagcatcatccactgcttttcagcggccaagaaaattgttgtgatagcagcaagaagcatgctccaatcaggcaactggttgataaaagttctggggggaggcgaaggtagatcatcatcatgcttgaagctttctttagatgtaacaactgtggttccattaattttcgaaggggcttgcgcctttgccttcaagccaccagaagacgcagatttggattttagtcctccaaggtttgcaggcccaccaccaagtttgctgcctgctccaccagagtccggcgagggtgaagtaacagggaaaaatgatgaagtagcagctgttgccacacgcgtttaaaatattggcttgattgcattggttgcctccattgcatggtaatgtggcattgtagagaagagatggtgagccacatgagtatcagttatgtgatgaaacaccttgttcagaatcccataatctctgtccatagttgccaaagctcccttcagccagtcccattctgatgaatcgtaatgaggcaaggcaaagtgtgtgtgctgcaaatatgtgatagtcacaagaaaaccgttcacaatgagcaaaggcaccccataaacacatagcagccaaaccaaccctttcagggttgcaacacggtagagagagtaagtcacagaaaacaaagcaacatcagagacatagatcagaagcctctcacggttagaatatatgggagcataagggtggtagtggcttgcaaaactatcatagggtctaccagagacattgaaggctaaatacataggccaccctattgtgagtgtgacgagaagagaaacagcccttcctagagggttgtttaagtacttggaaaaccatgcaactttggattttggttttgggacaaacacttcatcacgagatcttagtcaagggaacctgtgttggagtgatggcggcgatggcttattttccatgagaaataagggactaaaagtgttgagtgaagggtcaaacccacaacatcatcaacccattggtacttgctgaaggcatggtgaccacactcgtgagcaatcacccacacaccagtgagaaggcaaccttggagaacccaatagattggccatgcaatgagggaaaagggttgaggaaggaggtggaagtaggtggtggcaatgtagaaaatgaaggcaaatgaaaggtcataaacaacataggagaatgaagtgaggagggagcgctgaaagcagtgtggtggaattgctttcttgagttggccaacagtgaatggtggctttgtgtttggaacccttgagagaggcttcttcccttgaacttccactttggccacacgacctctacctcccattgttgtttcctttgctagacctagttaattaggtaccgcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgca

What is claimed is:

1. A transgenic soybean seed having an increased total fatty acid content of at least 10% when compared to the total fatty acid content of a non-transgenic, null segregant soybean seed, wherein the percentage of fatty acids in said soybean seed that are represented by linolenic acid is decreased, and wherein said seed comprises a recombinant construct having at least one diacylglycerol acyltransferase (DGAT) sequence, and wherein said at least one DGAT sequence comprises the nucleic acid sequence encoding a polypeptide having at least 95% sequence identity to the polypeptide having the amino acid sequence set forth in SEQ ID NO: 10.

2. The transgenic soybean seed of claim 1, wherein said transgenic soybean seed comprises an increased total fatty acid content of at least 10% and an increased oleic acid content of at least 25% when compared to the total fatty acid content and the oleic acid content of a non-transgenic, null segregant soybean seed.

3. The transgenic soybean seed of claim 1, wherein said at least one DGAT sequence comprises the nucleic acid sequence encoding a polypeptide having the amino acid sequence set forth in SEQ ID NO: 10.

4. The transgenic soybean seed of claim 1, wherein said at least one DGAT sequence comprises the nucleic acid sequence set forth in SEQ ID NO: 9.

5. The transgenic soybean seed of claim 1, wherein said at least one DGAT sequence comprises the nucleic acid sequence having 95% sequence identity to the nucleic acid sequence set forth in SEQ ID NO: 9.

6. A method for increasing the total fatty acid content of a soybean seed comprising:
  (a) transforming at least one soybean cell with a recombinant construct having at least one diacylglycerol acyltransferase (DGAT) sequence, wherein said at least one DGAT sequence comprises the nucleic acid sequence encoding a polypeptide having at least 95% sequence identity to the polypeptide having the amino acid sequence set forth in SEQ ID NO: 10; and
  (b) selecting the transformed soybean cell(s) of step (a) having an increased total fatty acid content of at least 10% when compared to the total fatty acid content of a non-transgenic, null segregant soybean seed, wherein the percentage of fatty acids in said soybean seed that are represented by linolenic acid is decreased.

7. The method of claim 6, wherein said at least one DGAT sequence comprises the nucleic acid sequence encoding a polypeptide having the amino acid sequence set forth in SEQ ID NO: 10.

8. The method of claim 6, wherein said at least one DGAT sequence comprises the nucleic acid sequence set forth in SEQ ID NO: 9.

9. The method of claim 6, wherein said at least one DGAT sequence comprises the nucleic acid sequence having 95% sequence identity to the nucleic acid sequence set forth in SEQ ID NO: 9.

10. A transgenic corn kernel having an increased total fatty acid content of at least 10% when compared to the total fatty acid content of a non-transgenic, null segregant corn kernel, wherein the percentage of fatty acids in said corn kernel that are represented by linolenic acid is decreased, and wherein said transgenic corn kernel comprises a recombinant construct having at least one diacylglycerol acyltransferase (DGAT) sequence, and wherein said at least one DGAT sequence comprises the nucleic acid sequence encoding a polypeptide having at least 95% sequence identity to the polypeptide having the amino acid sequence set forth in SEQ ID NO: 10.

11. The transgenic corn kernel of claim 10, wherein said at least one DGAT sequence comprises the nucleic acid sequence encoding a polypeptide having the amino acid sequence set forth in SEQ ID NO: 10.

12. The transgenic corn kernel of claim 10, wherein said at least one DGAT sequence comprises the nucleic acid sequence set forth in SEQ ID NO: 9.

13. The transgenic corn kernel of claim 10, wherein said at least one DGAT sequence comprises the nucleic acid sequence having 95% sequence identity to the nucleic acid sequence set forth in SEQ ID NO: 9.

14. A method for increasing the total fatty acid content of a corn kernel comprising:
  (a) transforming at least one corn kernel with a recombinant construct having at least one diacylglycerol acyltransferase (DGAT) sequence, wherein said at least one DGAT sequence comprises the nucleic acid sequence encoding a polypeptide having at least 95% sequence identity to the polypeptide having the amino acid sequence set forth in SEQ ID NO: 10; and
  (b) selecting the transformed corn kernel(s) of step (a) having an increased total fatty acid content of at least 10% when compared to the total fatty acid content of a non-transgenic, null segregant corn kernel, wherein the percentage of fatty acids in said corn kernel that are represented by linolenic acid is decreased.

15. The method of claim 14, wherein said at least one DGAT sequence comprises the nucleic acid sequence encoding a polypeptide having the amino acid sequence set forth in SEQ ID NO: 10.

16. The method of claim 14, wherein said at least one DGAT sequence comprises the nucleic acid sequence set forth in SEQ ID NO: 9.

17. The method of claim 14, wherein said at least one DGAT sequence comprises the nucleic acid sequence having 95% sequence identity to the nucleic acid sequence set forth in SEQ ID NO: 9.

18. A method for increasing the total fatty acid content and oleic acid content of a soybean seed comprising:
  (a) transforming at least one soybean cell with a recombinant construct having at least one diacylglycerol acyltransferase (DGAT) sequence, wherein said at least one DGAT comprises the nucleic acid sequence encoding a polypeptide having at least 95% sequence identity to the polypeptide having the amino acid sequence set forth in SEQ ID NO: 10; and
  (b) selecting the transformed soybean cell(s) of step (a) having an increased total fatty acid content of at least 10% and an increased oleic acid content of at least 25% when compared to the total fatty acid content and the oleic acid content of a non-transgenic, null segregant soybean seed, wherein the percentage of fatty acids in said soybean seed that are represented by linolenic acid is decreased.

19. Transgenic soybeans produced by the method of claim 18.

20. A product or a by-product obtained from the transgenic soybeans of claim 19 wherein the product or by-product comprises said recombinant construct or the polypeptide encoded thereby.

21. The method of claim 18, wherein said at least one DGAT sequence comprises the nucleic acid sequence encoding a polypeptide having the amino acid sequence set forth in SEQ ID NO: 10.

22. The method of claim 18, wherein said at least one DGAT sequence comprises the nucleic acid sequence set forth in SEQ ID NO: 9.

23. The method of claim 18, wherein said at least one DGAT sequence comprises the nucleic acid sequence having 95% sequence identity to the nucleic acid sequence set forth in SEQ ID NO: 9.

24. A method for increasing the total fatty acid content and decreasing the linolenic acid content of a soybean seed comprising:
(a) transforming at least one soybean cell with a recombinant construct having at least one diacylglycerol acyltransferase (DGAT) sequence, wherein said at least one DGAT sequence comprises the nucleic acid sequence encoding a polypeptide having at least 95% sequence identity to the polypeptide having the amino acid sequence set forth in SEQ ID NO: 10; and
(b) selecting the transformed soybean cell(s) of step (a) having an increased total fatty acid content of at least 10% and a decreased linolenic acid content of at least 25% when compared to the total fatty acid content and the linolenic acid content of a non-transgenic, null segregant soybean seed.

25. The method of claim 24, wherein said at least one DGAT sequence comprises the nucleic acid sequence encoding a polypeptide having the amino acid sequence set forth in SEQ ID NO: 10.

26. The method of claim 24, wherein said at least one DGAT sequence comprises the nucleic acid sequence set forth in SEQ ID NO: 9.

27. The method of claim 24, wherein said at least one DGAT sequence comprises the nucleic acid sequence having 95% sequence identity to the nucleic acid sequence set forth in SEQ ID NO: 9.

28. Transgenic soybeans produced by the method of claim 24.

29. A product or a by-product obtained from the transgenic soybeans of claim 28 wherein the product or by-product comprises said recombinant construct or the polypeptide encoded thereby.

30. A method for increasing the total fatty acid content and decreasing the linoleic acid content of a soybean seed comprising:
(a) transforming at least one soybean cell with a recombinant construct having at least one diacylglycerol acyltransferase (DGAT) sequence, wherein said at least one DGAT sequence comprises the nucleic acid sequence encoding a polypeptide having at least 95% sequence identity to the polypeptide having the amino acid sequence set forth in SEQ ID NO: 10; and
(b) selecting the transformed soybean cell(s) of step (a) having an increased total fatty acid content of at least 10% and a decreased linoleic acid content of at least 4% when compared to the total fatty acid content and the linoleic acid content of a non-transgenic, null segregant soybean seed, wherein the percentage of fatty acids in said soybean seed that are represented by linolenic acid is decreased.

31. Transgenic soybeans produced by the method of claim 30.

32. A product or a by-product obtained from the transgenic soybeans of claim 31 wherein the product or by-product comprises said recombinant construct or the polypeptide encoded thereby.

33. The method of claim 30, wherein said at least one DGAT sequence comprises the nucleic acid sequence encoding a polypeptide having the amino acid sequence set forth in SEQ ID NO: 10.

34. The method of claim 30, wherein said at least one DGAT sequence comprises the nucleic acid sequence set forth in SEQ ID NO: 9.

35. The method of claim 30, wherein said at least one DGAT sequence comprises the nucleic acid sequence having 95% sequence identity to the nucleic acid sequence set forth in SEQ ID NO: 9.

36. A method for increasing the total fatty acid content and decreasing the palmitic acid content of a soybean seed comprising:
(a) transforming at least one soybean cell with a recombinant construct having at least one diacylglycerol acyltransferase (DGAT) sequence, wherein said at least one DGAT sequence comprises the nucleic acid sequence encoding a polypeptide having at least 95% sequence identity to the polypeptide having the amino acid sequence set forth in SEQ ID NO: 10; and
(b) selecting the transformed soybean cell(s) of step (a) having an increased total fatty acid content of at least 10% and a decreased palmitic acid content of at least 8% when compared to the total fatty acid content and the palmitic acid content of a non-transgenic, null segregant soybean seed, wherein the percentage of fatty acids in said soybean seed that are represented by linolenic acid is decreased.

37. Transgenic soybeans produced by the method of claim 36.

38. A product or a by-product obtained from the transgenic soybeans of claim 37 wherein the product or by-product comprises said recombinant construct or the polypeptide encoded thereby.

39. The method of claim 36, wherein said at least one DGAT sequence comprises the nucleic acid sequence encoding a polypeptide having the amino acid sequence set forth in SEQ ID NO: 10.

40. The method of claim 36, wherein said at least one DGAT sequence comprises the nucleic acid sequence set forth in SEQ ID NO: 9.

41. The method of claim 36, wherein said at least one DGAT sequence comprises the nucleic acid sequence having 95% sequence identity to the nucleic acid sequence set forth in SEQ ID NO: 9.

42. A method for increasing the total fatty acid content and the stearic acid content of a soybean seed comprising:
(a) transforming at least one soybean cell with a recombinant construct having at least one diacylglycerol acyltransferase (DGAT) sequence, wherein said at least one DGAT sequence comprises the nucleic acid sequence encoding a polypeptide having at least 95% sequence identity to the polypeptide having the amino acid sequence set forth in SEQ ID NO: 10; and
(b) selecting the transformed soybean cell(s) of step (a) having an increased total fatty acid content of at least 10% and an increased stearic acid content of at least 14% when compared to the total fatty acid content and the stearic acid content of a non-transgenic, null segregant soybean seed, wherein the percentage of fatty acids in said soybean seed that are represented by linolenic acid is decreased.

43. Transgenic soybeans produced by the method of claim 42.

44. A product or a by-product obtained from the transgenic soybeans of claim 43 wherein the product or by-product comprises said recombinant construct or the polypeptide encoded thereby.

45. The method of claim 42, wherein said at least one DGAT sequence comprises the nucleic acid sequence encoding a polypeptide having the amino acid sequence set forth in SEQ ID NO: 10.

46. The method of claim 42, wherein said at least one DGAT sequence comprises the nucleic acid sequence set forth in SEQ ID NO: 9.

47. The method of claim 42, wherein said at least one DGAT sequence comprises the nucleic acid sequence having 95% sequence identity to the nucleic acid sequence set forth in SEQ ID NO: 9.

48. An isolated polynucleotide comprising:
(a) a nucleotide sequence encoding a polypeptide having diacylglycerol acyltransferase activity wherein the polypeptide is set forth in SEQ ID NOs:83, 88, or 93; or
(b) a complement of the nucleotide sequence of (a), wherein the complement and the nucleotide sequence consist of the same number of nucleotides and are 100% complementary.

49. A recombinant DNA construct comprising the isolated polynucleotide of claim 48 operably linked to at least one regulatory sequence.

50. A cell comprising in its genome a recombinant DNA construct, wherein said recombinant DNA construct comprises a polynucleotide operably linked to at least one regulatory sequence, wherein said polynucleotide comprises a nucleotide sequence encoding a polypeptide having diacylglycerol acyltransferase activity, wherein the polypeptide is set forth in SEQ ID NOs:83, 88, or 93.

51. The cell of claim 50 wherein said cell is an oilseed plant cell.

52. A transgenic oilseed plant or transgenic oilseed seed comprising a recombinant construct in its genome, wherein said recombinant DNA construct comprises a polynucleotide operably linked to at least one regulatory sequence, wherein said polynucleotide comprises a nucleotide sequence encoding a polypeptide having diacylglycerol acyltransferase activity, wherein the polypeptide is set forth in SEQ ID NOs:83, 88, or 93.

53. The oilseed plant or the oilseed seed of claim 52 wherein said oilseed plant or oilseed seed is selected from the group consisting of soybean, corn, canola, sunflower, flax, cotton, and safflower.

54. A method for increasing the total fatty acid content of an oilseed seed comprising:
(a) transforming at least one oilseed cell with a recombinant construct, wherein said recombinant DNA construct comprises a polynucleotide operably linked to at least one regulatory sequence, wherein said polynucleotide comprises a nucleotide sequence encoding a polypeptide having diacylglycerol acyltransferase activity, wherein the polypeptide is set forth in SEQ ID NOs: 83, 88, or 93;
(b) regenerating a transgenic oilseed plant from the at least one transformed oilseed cell of (a);
(c) obtaining a transgenic oilseed seed from said transgenic oilseed plant of (b); and
(d) selecting the transgenic oilseed seed of step (c) having an increased total fatty acid content when compared to the total fatty acid content of a non-transgenic, null segregant oilseed seed.

55. The method of claim 54 wherein the transgenic oilseed plant or transformed oilseed seed is selected from the group consisting of soybean, corn, canola, sunflower, flax, cotton, and safflower.

* * * * *